(12) United States Patent
MacDonald et al.

(10) Patent No.: US 10,072,076 B2
(45) Date of Patent: Sep. 11, 2018

(54) HUMAN ANTIBODIES TO NA$_v$1.7

(71) Applicant: Regeneron Pharmaceuticals, Inc., Tarrytown, NY (US)

(72) Inventors: Lynn MacDonald, White Plains, NY (US); Andrew J. Murphy, Croton-on-Hudson, NY (US); Nicholas J. Papadopoulos, Lagrangeville, NY (US); Neil Stahl, Carmel, NY (US); Nicole Alessandri-Haber, Rye Brook, NY (US)

(73) Assignee: Regeneron Pharmaceuticals, Inc., Tarrytown, NY (US)

( * ) Notice: Subject to any disclaimer, the term of this patent is extended or adjusted under 35 U.S.C. 154(b) by 84 days.

(21) Appl. No.: 14/775,624

(22) PCT Filed: Mar. 12, 2014

(86) PCT No.: PCT/US2014/024336
§ 371 (c)(1),
(2) Date: Sep. 11, 2015

(87) PCT Pub. No.: WO2014/159595
PCT Pub. Date: Oct. 2, 2014

(65) Prior Publication Data
US 2016/0024208 A1   Jan. 28, 2016

Related U.S. Application Data

(60) Provisional application No. 61/783,094, filed on Mar. 14, 2013.

(51) Int. Cl.
*C07K 16/28* (2006.01)
*A61K 45/06* (2006.01)
*A61K 39/395* (2006.01)
*A61K 39/00* (2006.01)

(52) U.S. Cl.
CPC .......... *C07K 16/28* (2013.01); *A61K 39/3955* (2013.01); *A61K 45/06* (2013.01); *A61K 2039/505* (2013.01); *C07K 2317/21* (2013.01); *C07K 2317/30* (2013.01); *C07K 2317/31* (2013.01); *C07K 2317/76* (2013.01); *C07K 2317/92* (2013.01)

(58) Field of Classification Search
CPC ................ C07K 16/28; C07K 2317/21; C07K 2317/30; A61K 39/3955; A61K 45/06; A61K 2039/505
See application file for complete search history.

(56) References Cited

U.S. PATENT DOCUMENTS

| | | |
|---|---|---|
| 2011/0307966 A1 | 12/2011 | MacDonald et al. |
| 2012/0083000 A1 | 4/2012 | Alessandri Haber et al. |
| 2013/0115171 A1 | 5/2013 | McDonough et al. |
| 2013/0243775 A1 | 9/2013 | Papadopoulos et al. |
| 2015/0232553 A1 | 8/2015 | Finney et al. |
| 2016/0237153 A1 | 8/2016 | Lee et al. |

FOREIGN PATENT DOCUMENTS

| | | |
|---|---|---|
| EP | 2527842 A1 | 11/2012 |
| WO | 11/051350 A1 | 5/2011 |
| WO | WO 11/051349 A1 | 5/2011 |
| WO | WO 11/052350 A1 | 5/2011 |
| WO | WO 01/159595 A2 | 10/2014 |
| WO | WO 15/032916 A1 | 3/2015 |
| WO | WO 15/035173 A1 | 3/2015 |
| WO | WO 16/063026 A2 | 4/2016 |

OTHER PUBLICATIONS

Paul, Fundamental Immunology, 3rd Edition, 1993, pp. 292-295.*
Vajdos et al., Comprehensive functional maps of the antigen-binding site of an anti-ErbB2 antibody obtained with shotgun scanning mutagenesis. J. Mol. Biol. 320:415-428, 2002.*
Dib-Hajj et al., "From genes to pain: NaV1.7 and human pain disorders," ScienceDirect, Trends in Neurosciences, 30(11):555-563, doi:10.1016/j.tins.2007.08.004, (2007).
Dib-Hajj et al., "Voltage-Gated Sodium Channels: Therapeutic Targets for Pain," Pain Medicine, 10(7):1260-1269, doi:10.1111/j.1526-4637.2009.00719, (2009).
Dray, "Neuropathic pain: emerging treatments" British Journal of Anaesthesia, 101(1):48-58, (2008).
Lee et al., "A monoclonal antibody that targets a NaV1.7 channel voltage sensor for pain and itch relief," Cell, 157(6):1393-1404, doi:10.1016/j.cell.2014.03.064, (2014).
Liu et al., "The Roles of Sodium Channels in Nociception: Implications for Mechanisms of Neuropathic Pain," Pain Medicine, 12:S93-S99, (2011).
Bi et al., "Involvement of trigeminal ganglionic Na v 1.7 in hyperalgesia of inflamed temporomandibular joint is dependent on ERK1/2 phosphorylation of glial cells in rats," European Journal of Pain 17(7):983-994, (2012).
Clare, "Targeting voltage-gated sodium channels for pain therapy", Expert Opinion on Investigational Drugs, 19(1):45-62, (2010).
Dallas et al., "Immunopharmacology: utilizing antibodies as ion channel modulators," Expert Review of Clinical Pharmacology, 3(3):281-289, (2010).
Dib-Hajj et al., "The NaV1.7 sodium channel: from molecule to man," Nature Reviews Neuroscience, 14(1):49-62, (2013). Published online Dec. 12, 2012.

(Continued)

*Primary Examiner* — Ruixiang Li

(74) *Attorney, Agent, or Firm* — Schwabe, Williamson & Wyatt PC; Anna DiGabriele Petti

(57) ABSTRACT

The present invention provides antibodies that bind to the human voltage gated sodium channel designated Na$_v$1.7 and methods of using same. According to certain embodiments of the invention, the antibodies are fully human antibodies that bind to human Na$_v$1.7 (hNa$_v$1.7). The antibodies of the invention are useful for the treatment of diseases and disorders associated with one or more Na$_v$1.7 biological activities, including the treatment of acute or chronic pain conditions, or inflammatory conditions.

10 Claims, 3 Drawing Sheets

Specification includes a Sequence Listing.

(56) References Cited

OTHER PUBLICATIONS

Gingras et al., "Global Nav1.7 Knockout Mice Recapitulate the Phenotype of Human Congenital Indifference to Pain," PLOS ONE, 14 pages, 9(9):e105895, (2014).
Lee et al., "A Monoclonal Antibody that Targets a Nav1.7 Channel Voltage Sensor for Pain and Itch Relief," Cell, 12 pages, (2014). [Retrieved from the Internet: <URL: http://dx.doi.org/10.10164.cell.201.03.064>].
Shields et al., "Sodium Channel Nav1.7 Is Essential for Lowering Heat Pain Threshold after Burn Injury", Journal of Neuroscience, 32(32):10819-10832, (2012).
WIPO Application No. PCT/US2014/024336, PCT International Preliminary Report on Patentability dated Sep. 24, 2015.
WIPO Application No. PCT/US2014/024336, PCT International Search Report and Written Opinion of the International Searching Authority dated Oct. 8, 2014.
U.S. Appl. No. 61/783,094, filed Mar. 14, 2013, Expired.
PCT/US2014/024336, Mar. 12, 2014, WO 2014/159595, Expired.

\* cited by examiner

HUMAN ANTIBODIES TO NA$_v$1.7

CROSS-REFERENCE TO RELATED APPLICATIONS

This application is a US national stage of International Application No. PCT/US2014/024336, filed Mar. 12, 2014, which claims the benefit under 35 USC § 119(e) of U.S. Provisional Application No. 61/783,094, filed Mar. 14, 2013. Each of these applications is incorporated herein by reference in its entirety for all purposes.

SEQUENCE LISTING

This application incorporates by reference the Sequence Listing submitted in Computer Readable Form as file 463837-Sequence.txt, created on Sep. 11, 2015 and containing 657,205 bytes.

FIELD OF THE INVENTION

The present invention is related to human antibodies and antigen-binding fragments of human antibodies that specifically bind the human sodium channel Na$_v$1.7, and therapeutic methods of using those antibodies.

STATEMENT OF RELATED ART

Na$_v$1.7 is a member of the family of voltage-gated sodium channels (VGSCs or Nav), which are important for electrogenesis and nerve impulse conduction in various types of excitable cells. VGSCs are heterodimeric complexes consisting of a large central pore-forming α-subunit and two smaller auxiliary β-subunits. The pore-forming α-subunit is sufficient for functional expression, but the kinetics and voltage dependence of channel gating are modified by the β-subunits. The α-subunit has four repeat domains, I through IV (also referred to as A, B, C and D, or 1, 2, 3 and 4), each containing six membrane-spanning regions, labeled S1 through S6. There are ten cloned α-subunits and four β-subunits. These distinct sodium channels have similar structural and functional properties, but they initiate action potential in different cell types and have distinct regulatory and pharmacological properties. The ten different genes encode ten isoforms of the sodium channel protein, and while they all share a common structure, they have different amino acid sequences.

Na$_v$1.7, which is encoded by SCN9A, is important for electrical signaling primarily in nociceptive dorsal root ganglia neurons and sympathetic ganglion neurons. It is expressed at the endings of nociceptors close to where the impulse is initiated (Toledo-Aral, et al. (1997), PNAS 94:1527-1532).

The role of Na$_v$1.7 in pain was determined in mice that were genetically engineered to lack Na$_v$1.7. More specifically, knockout mice that lacked Na$_v$1.7 in nociceptors showed reduced response to inflammatory pain (Nassar et al. (2004), PNAS 101:12706-12711). Furthermore, erythromelalgia, an inherited neuropathy wherein patients experience a severe burning pain in response to mild warmth, appears to be the result of mutations in Na$_v$1.7, which cause excessive channel activity (Drenth et al. (2001), Am. J. Hum. Genet. 68:1277-1282; Cummins et al., (2004), J. Neurosci 24:8232-8236). SCN9A mutations that resulted in the loss of Na$_v$1.7 function, and which also resulted in the loss of pain, were identified in three families from Pakistan. All of the mutations observed were nonsense mutations with the majority of affected patients having homozygous mutations in the SCN9A gene. This observation linked the loss of Na$_v$1.7 function with an inability to experience pain (Cox et al., (2006), Nature 444:894-898).

Antibodies that bind an extracellular pore-forming region of a sodium ion channel or that inhibit ion transport of a functional potassium, sodium, or calcium channel are described in US2005/0271656, US2011/0135662, US2012/0259096, EP2493926A1, WO2007/023298 and WO2011/051350. Methods of producing local anesthesia by administering a sodium channel blocking agent are described in, for example, U.S. Pat. No. 6,407,088; U.S. Pat. No. 6,599,906; and U.S. Pat. No. 6,548,507. Methods for identifying agents that modulate the activity of the Na$_v$1.7 ion channel are described in WO2007/109324.

BRIEF SUMMARY OF THE INVENTION

In a first aspect, the invention provides fully human monoclonal antibodies (mAbs) and antigen-binding fragments thereof that specifically bind to human Na$_v$1.7 and inhibit or block its activity. The antibodies or antigen binding fragments thereof may be useful for ameliorating pain associated with the presence of Na$_v$1.7 in cells.

The antibodies of the invention can be full-length (for example, an IgG1 or IgG4 antibody) or may comprise only an antigen-binding portion (for example, a Fab, F(ab')$_2$ or scFv fragment), and may be modified to affect functionality, e.g., to eliminate residual effector functions (Reddy et al., 2000, J. Immunol. 164:1925-1933).

In one embodiment, the isolated human antibody or antigen-binding fragment of a human antibody that specifically binds to human Na$_v$1.7, binds to at least one extracellular (EC) loop, or a fragment thereof, or to the paddle region, or a fragment hereof, of human Na$_v$1.7.

In one embodiment, the EC loop to which the antibody binds may be selected from EC1, EC2 and EC3 within any one of domains 1, 2, 3 or 4.

In another embodiment, the EC loop to which the antibody binds may be extracellular loop 3 (EC3) within domain 1, which domain comprises amino acid residues ranging from about residue number 269 to about residue 338 of SEQ ID NO: 670.

In another embodiment, the EC loop to which the antibody binds may be extracellular loop 3 (EC3) within domain 3, which domain comprises amino acid residues ranging from about residue number 1333 to about residue 1382 of SEQ ID NO: 670.

In another embodiment, the antibody may bind to the paddle region of Nav1.7, which paddle region comprises amino acid residues ranging from about residue number 202 to about residue 232 of SEQ ID NO: 670.

In certain embodiments, the antibody does not bind to one or more of SEQ ID NOs: 838 through 852.

In one embodiment, the invention comprises an antibody or antigen-binding fragment of an antibody comprising a heavy chain variable region (HCVR) having an amino acid sequence selected from any of the variable heavy (V$_H$) amino acid sequences depicted in Table 1, or a substantially similar sequence thereof having at least 90%, at least 95%, at least 98% or at least 99% sequence identity. In one embodiment, the invention comprises an antibody or antigen-binding fragment of an antibody comprising a HCVR having an amino acid sequence selected from the group consisting of SEQ ID NO: 2, 6, 10, 14, 18, 22, 26, 30, 34, 38, 42, 46, 50, 54, 58, 62, 66, 70, 74, 78, 82, 86, 90, 94, 98, 102, 106, 110, 681, 685, 689, 693, 697, 701, 705, 709, and 722, 727, 743, 759, 791, 807, 823, 860, 864, 868 and 872, or a substantially similar sequence thereof having at least 90%, at least 95%, at least 98% or at least 99% sequence identity. In one embodiment, the antibody or antigen-binding fragment of an antibody comprises a HCVR having an amino acid sequence selected from the group consisting of SEQ ID NO: 18, 22, 46, 50, 66, 70, 82, 86, 90, 94, 102, 689, 693, 705 and 709, or a substantially similar sequence thereof having at least 90%, at least 95%, at least 98% or at least 99% sequence identity. In one embodiment, the antibody or antigen-binding fragment of an antibody comprises a HCVR having an amino acid sequence selected from the group consisting of SEQ ID NO: 14, 22, 30, 98, 701, 722, 727, 759, 860, 864, 868 and 872, or a substantially similar sequence thereof having at least 90%, at least 95%, at least 98% or at least 99% sequence identity. In one embodiment, position number seven of the amino acid sequence of the $V_H$ chain of the antibody designated as H4H439P (SEQ ID NO: 70) may be a serine (S), or a tryptophan (W). In one embodiment, the antibody or antigen-binding fragment of a human antibody that binds human $Na_v1.7$, further comprises a light chain variable region (LCVR) having an amino acid sequence selected from the group consisting of SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 683, 687, 691, 695, 699, 703, 707, 711, 724, 735, 751, 767, 799, 815, 831, 862, 866, 870 and 874 or a substantially similar sequence thereof having at least 90%, at least 95%, at least 98% or at least 99% sequence identity. In one embodiment, the antibody or antigen-binding fragment of an antibody comprises a LCVR having an amino acid sequence selected from the group consisting of SEQ ID NO: SEQ ID NO: 16, 24, 32, 100, 703, 724, 735, 767, 862, 866, 870 and 874, or a substantially similar sequence thereof having at least 90%, at least 95%, at least 98% or at least 99% sequence identity.

In one embodiment, the invention comprises an antibody or antigen-binding fragment of an antibody comprising a LCVR having an amino acid sequence selected from any of the variable light ($V_L$) protein sequences depicted in Table 1, or a substantially similar sequence thereof having at least 90%, at least 95%, at least 98% or at least 99% sequence identity. In one embodiment, the invention comprises an antibody or antigen-binding fragment of an antibody comprising a LCVR having an amino acid sequence selected from the group consisting of SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 683, 687, 691, 695, 699, 703, 707, 711, 724, 735, 751, 767, 799, 815, 831, 862, 866, 870 and 874 or a substantially similar sequence thereof having at least 90%, at least 95%, at least 98% or at least 99% sequence identity. In one embodiment, the antibody or antigen-binding fragment of an antibody comprises a LCVR having an amino acid sequence selected from the group consisting of SEQ ID NO: 20, 24, 48, 52, 68, 72, 84, 88, 92, 96, 104, 691, 695, and 707. In one embodiment, the antibody or antigen-binding fragment of an antibody comprises a LCVR having an amino acid sequence selected from the group consisting of SEQ ID NO: 16, 24, 32, 100, 703, 724, 735, 767, 862, 866, 870 and 874.

In certain embodiments, the antibody or fragment thereof comprises a HCVR/LCVR amino acid sequence pair selected from the group consisting of SEQ ID NO: 2/4, 6/8, 10/12, 14/16, 18/20, 22/24, 26/28, 30/32, 34/36, 38/40, 42/44, 46/48, 50/52, 54/56, 58/60, 62/64, 66/68, 70/72, 74/76, 78/80, 82/84, 86/88, 90/92, 94/96, 98/100, 102/104, 106/108, 110/112, 681/683, 685/687, 689/691, 693/695, 697/699, 701/703, 705/707, 709/711, 722/724, 727/735, 743/751, 759/767, 791/799, 807/815, 823/831, 860/862, 864/866, 868/870 and 872/874.

In one embodiment, the HCVR/LCVR amino acid sequence pair is selected from the group consisting of SEQ ID NO: 18/20, 22/24, 46/48, 50/52, 66/68, 70/72, 82/84, 86/88, 90/92, 94/96, 102/104, 689/691, 693/695, and 705/707.

In one embodiment, the HCVR/LCVR amino acid sequence pair is selected from the group consisting of SEQ ID NO: 14/16, 22/24, 30/32, 98/100, 701/703, 722/724, 727/735, 759/767, 860/862, 864/866, 868/870 and 872/874.

In a second aspect, the present invention provides an isolated human antibody or an antigen-binding fragment thereof that binds specifically to human $Na_v1.7$, wherein the antibody comprises a HCVR comprising the three heavy chain CDRs (HCDR1, HCDR2 and HCDR3) contained within the HCVR sequence selected from the group consisting of SEQ ID NO: 2, 6, 10, 14, 18, 22, 26, 30, 34, 38, 42, 46, 50, 54, 58, 62, 66, 70, 74, 78, 82, 86, 90, 94, 98, 102, 106, 110, 681, 685, 689, 693, 697, 701, 705, 709, 722, 727, 743, 759, 791, 807, 823, 860, 864, 868 and 872; and a LCVR comprising the three light chain CDRs (LCDR1, LCDR2 and LCDR3) contained within the LCVR sequences selected from the group consisting of SEQ ID NO: 4, 8, 12, 16, 20, 24, 28, 32, 36, 40, 44, 48, 52, 56, 60, 64, 68, 72, 76, 80, 84, 88, 92, 96, 100, 104, 108, 112, 683, 687, 691, 695, 699, 703, 707, 711, 724, 735, 751, 767, 799, 815, 831, 862, 866, 870 and 874.

In a third aspect, the present invention also provides an antibody or antigen-binding fragment of an antibody comprising a HCDR3 domain having an amino acid sequence selected from any of those shown in Table 2, or a substantially similar sequence thereof having at least 90%, at least 95%, at least 98% or at least 99% sequence identity; and a LCDR3 domain having an amino acid sequence selected from any of those shown in Table 2, or a substantially similar sequence thereof having at least 90%, at least 95%, at least 98% or at least 99% sequence identity.

A fourth aspect of the invention provides an antibody or fragment thereof further comprising a HCDR1 domain having an amino acid sequence of any of those shown in Table 2, or a substantially similar sequence thereof having at least 90%, at least 95%, at least 98% or at least 99% sequence identity; a HCDR2 domain having an amino acid sequence of any of those shown on Table 2, or a substantially similar sequence thereof having at least 90%, at least 95%, at least 98% or at least 99% sequence identity; a LCDR1 domain having an amino acid sequence of any of those shown in Table 2, or a substantially similar sequence thereof having at least 90%, at least 95%, at least 98% or at least 99% sequence identity; and a LCDR2 domain having an amino acid sequence of any of those shown in Table 2, or a substantially similar sequence thereof having at least 90%, at least 95%, at least 98% or at least 99% sequence identity.

In one embodiment, the antibody or antigen-binding portion of an antibody comprises:

(a) a HCDR3 domain having an amino acid sequence selected from the group consisting of residues 97-112 of SEQ ID NO: 18; residues 97-107 of SEQ ID NOs: 14, 22, 727, or 759; residues 97-108 of SEQ ID NO:46 or 50; residues 96-110 of SEQ ID NO: 66, 70, 701 or 864; residues 97-117 of SEQ ID NO: 82 or 86; residues 97-116 of SEQ ID NO: 90 or 94; residues 98-110 of SEQ ID NO: 102 or 705; and residues 97-111 of SEQ ID NO: 689 or 693; residues 97-106 of SEQ ID NOs: 30, 722, 868 or 872; residues 96-108 of SEQ ID NOs: 98 or 860; and (b) a LCDR3 domain having an amino acid sequence selected from the group consisting of residues 89-97 of SEQ ID NO: 20, 68, 72, 84, 88, 92, 96, 104, 703, 707, 724, 866 or 874; residues 95-103 of SEQ ID NO: 32, 48, 52, 691, 695, or 870; and residues 94-102 of SEQ ID NO: 16, 24, 735 or 767.

In one embodiment, the antibody or antigen-binding portion of the antibody further comprises:

(c) a HCDR1 domain having an amino acid sequence selected from the group consisting of residues 26-33 of SEQ ID NO: 14, 18, 22, 30, 46, 50, 66, 70, 82, 86, 90, 94, 98, 689, 693, 701, 722, 727, 759, 860, 864, 868, or 872; and residues 26-35 of SEQ ID NO: 102 or 705;

(d) a HCDR2 domain having an amino acid sequence selected from the group consisting of residues 51-58 of SEQ ID NO: 14, 18, 22, 30, 46, 50, 82, 86, 90, 94, 689, 693, 722, 727, 759, 868, or 872; residues 51-57 of SEQ ID NO: 66, 70, 98, 701, 860, or 864; and residues 53-59 of SEQ ID NO: 102 or 705;

(e) a LCDR1 domain having an amino acid sequence selected from the group consisting of residues 27-32 of SEQ ID NO: 20, 68, 72, 84, 88, 92, 96, 104, 703, 707, 724, 866, or 874; residues 27-37 of SEQ ID NO: 16, 24, 735, or 767; and residues 27-38 of SEQ ID NO: 32, 48, 52, 100, 691, 695, 862, or 870; and (f) a LCDR2 domain having an amino acid sequence selected from the group consisting of residues 50-52 of SEQ ID NO: 20, 68, 72, 84, 88, 92, 96, 104, 703, 707, 724, 866, or 874; residues 55-57 of SEQ ID NO: 16, 24, 735, or 767; and residues 56-58 of SEQ ID NO: 32, 48, 52, 100, 691, 695, 862, or 870.

In certain embodiments, the antibody or antigen-binding portion of an antibody that specifically binds to human Na$_v$1.7 comprises a HCDR3/LCDR3 amino acid sequence pair selected from any of the HCDR3/LCDR3 amino acid sequences shown in Table 2. According to certain embodiments, the antibody or antigen-binding portion of an antibody comprises a HCDR3/LCDR3 amino acid sequence pair selected from the group consisting of residues 97-112 of SEQ ID NO: 18/residues 89-97 of SEQ ID NO: 20; residues 97-107 of SEQ ID NO: 22/residues 94-102 of SEQ ID NO: 24; residues 97-108 of SEQ ID NO:46 or 50/residues 95-103 of SEQ ID NO: 48 or 52; residues 96-110 of SEQ ID NO: 66 or 70/residues 89-97 of SEQ ID NO: 68 or 72; residues 97-117 of SEQ ID NO: 82 or 86/residues 89-97 of SEQ ID NO: 84 or 88; residues 97-116 of SEQ ID NO: 90 or 94/residues 89-97 of SEQ ID NO: 92 or 96; residues 98-110 of SEQ ID NO: 102 or 705/residues 89-97 of SEQ ID NO: 104 or 707; residues 97-111 of SEQ ID NO: 689 or 693/residue 95-103 of SEQ ID NO: 691 or 695, residues 97-107 of SEQ ID NO: 14/residues 94-102 of SEQ ID NO: 16; residues 97-107 of SEQ ID NO: 22/residues 94-102 of SEQ ID NO: 24; residues 97-107 of SEQ ID NO: 727/residues 94-102 of SEQ ID NO: 735; residues 97-107 of SEQ ID NO: 759/residues 94-102 of SEQ ID NO: 767; residues 97-106 of SEQ ID NO: 30/residues 95-103 of SEQ ID NO: 32; residues 97-106 of SEQ ID NO: 868/residues 95-103 of SEQ ID NO: 870; residues 96-110 of SEQ ID NO: 701/residues 89-97 of SEQ ID NO: 703; residues 96-110 of SEQ ID NO: 864/residues 89-97 of SEQ ID NO: 866; residues 96-108 of SEQ ID NO: 98/residues 95-99 of SEQ ID NO: 100; residues 96-108 of SEQ ID NO: 860/residues 95-99 of SEQ ID NO: 862; residues 97-106 of SEQ ID NO: 722/residues 89-97 of SEQ ID NO: 724; residues 97-106 of SEQ ID NO: 872/residues 89-97 of SEQ ID NO: 874.

In one embodiment, the antibody or antigen binding fragment thereof comprises the HCDR1, HCDR2 and HCDR3 sequences of residues 26-33, 51-58, and 97-112, respectively, of SEQ ID NO: 18 and LCDR1, LCDR2 and LCDR3 sequences of residues 27-32, 50-52, and 89-97, respectively, of SEQ ID NO: 20.

In one embodiment, the antibody or antigen binding fragment thereof comprises the HCDR1, HCDR2 and HCDR3 sequences of residues 26-33, 51-58, and 97-107, respectively, of SEQ ID NO: 22 and LCDR1, LCDR2 and LCDR3 sequences of residues 27-37, 55-57, and 94-102, respectively, of SEQ ID NO: 24.

In one embodiment, the antibody or antigen binding fragment thereof comprises the HCDR1, HCDR2 and HCDR3 sequences of residues 26-33, 51-58, and 97-108, respectively, of SEQ ID NO: 46 and LCDR1, LCDR2 and LCDR3 sequences of residues 27-38, 56-58, and 95-103, respectively, of SEQ ID NO: 48.

In one embodiment, the antibody or antigen binding fragment thereof comprises the HCDR1, HCDR2 and HCDR3 sequences of residues 26-33, 51-57, and 96-110, respectively, of SEQ ID NO: 66 and LCDR1, LCDR2 and LCDR3 sequences of residues 27-32, 50-52, and 89-97, respectively, of SEQ ID NO: 68.

In one embodiment, the antibody or antigen binding fragment thereof comprises the HCDR1, HCDR2 and HCDR3 sequences of residues 26-33, 51-58, and 97-117, respectively, of SEQ ID NO: 82 and LCDR1, LCDR2 and LCDR3 sequences of residues 27-32, 50-52, and 89-97, respectively, of SEQ ID NO: 84.

In one embodiment, the antibody or antigen binding fragment thereof comprises the HCDR1, HCDR2 and HCDR3 sequences of residues 26-33, 51-58, and 97-116, respectively, of SEQ ID NO: 90 and LCDR1, LCDR2 and LCDR3 sequences of residues 27-32, 50-52, and 89-97, respectively, of SEQ ID NO: 92.

In one embodiment, the antibody or antigen binding fragment thereof comprises the HCDR1, HCDR2 and HCDR3 sequences of residues 26-35, 53-59, and 98-110, respectively, of SEQ ID NO: 102 and LCDR1, LCDR2 and LCDR3 sequences of residues 27-32, 50-52, and 89-97, respectively, of SEQ ID NO: 104.

In one embodiment, the antibody or antigen binding fragment thereof comprises the HCDR1, HCDR2 and HCDR3 sequences of residues 26-33, 51-58, and 97-111, respectively, of SEQ ID NO: 689 and LCDR1, LCDR2 and LCDR3 sequences of residues 27-38, 56-58, and 95-103, respectively, of SEQ ID NO: 691.

In one embodiment, the antibody or antigen binding fragment thereof comprises the HCDR1, HCDR2 and HCDR3 sequences of residues 26-33, 51-58, and 97-107, respectively, of SEQ ID NO: 14 and LCDR1, LCDR2 and LCDR3 sequences of residues 27-37, 55-57, and 94-102, respectively, of SEQ ID NO: 16.

In one embodiment, the antibody or antigen binding fragment thereof comprises the HCDR1, HCDR2 and HCDR3 sequences of residues 26-33, 51-58, and 97-107, respectively, of SEQ ID NO: 22 and LCDR1, LCDR2 and LCDR3 sequences of residues 27-37, 55-57, and 94-102, respectively, of SEQ ID NO: 24.

In one embodiment, the antibody or antigen binding fragment thereof comprises the HCDR1, HCDR2 and HCDR3 sequences of residues 26-33, 51-58, and 97-107, respectively, of SEQ ID NO: 727 and LCDR1, LCDR2 and LCDR3 sequences of residues 27-37, 55-57, and 94-102, respectively, of SEQ ID NO: 735.

In one embodiment, the antibody or antigen binding fragment thereof comprises the HCDR1, HCDR2 and HCDR3 sequences of residues 26-33, 51-58, and 97-107, respectively, of SEQ ID NO: 759 and LCDR1, LCDR2 and LCDR3 sequences of residues 27-37, 55-57, and 94-102, respectively, of SEQ ID NO: 767.

In one embodiment, the antibody or antigen binding fragment thereof comprises the HCDR1, HCDR2 and HCDR3 sequences of residues 26-33, 51-58, and 97-106, respectively, of SEQ ID NO: 30 or 868 and LCDR1, LCDR2 and LCDR3 sequences of residues 27-38, 56-58, and 95-103, respectively, of SEQ ID NO: 32 or 870.

In one embodiment, the antibody or antigen binding fragment thereof comprises the HCDR1, HCDR2 and HCDR3 sequences of residues 26-33, 51-57, and 96-110, respectively, of SEQ ID NO: 701, or 864 and LCDR1, LCDR2 and LCDR3 sequences of residues 27-32, 50-52, and 89-97, respectively, of SEQ ID NO: 703, or 866.

In one embodiment, the antibody or antigen binding fragment thereof comprises the HCDR1, HCDR2 and HCDR3 sequences of residues 26-33, 51-57, and 96-108, respectively, of SEQ ID NO: 98, or 860 and LCDR1, LCDR2 and LCDR3 sequences of residues 27-38, 56-58, and 95-99, respectively, of SEQ ID NO: 100, or 862.

In one embodiment, the antibody or antigen binding fragment thereof comprises the HCDR1, HCDR2 and HCDR3 sequences of residues 26-33, 51-58, and 97-106, respectively, of SEQ ID NO: 722, or 872 and LCDR1, LCDR2 and LCDR3 sequences of residues 27-32, 50-52, and 89-97, respectively, of SEQ ID NO: 724, or 874.

Certain non-limiting, exemplary antibodies and antigen-binding fragments of the invention comprise HCDR1, HCDR2, HCDR3, LCDR1, LCDR2 and LCDR3 domains, respectively, selected from any of the amino acid sequences shown in Tables 1 or 2.

In one embodiment, the antibody or antigen-binding fragment binds human, monkey, mouse and rat $Na_v1.7$.

In one embodiment, the antibody or antigen-binding fragment binds human, monkey and mouse $Na_v1.7$, but does not bind rat $Na_v1.7$.

In one embodiment, the antibody or antigen-binding fragment binds human, monkey and rat $Na_v1.7$, but does not bind mouse $Na_v1.7$.

In one embodiment, the antibody or antigen-binding fragment binds human and monkey $Na_v1.7$, but does not bind rat or mouse $Na_v1.7$.

In one embodiment, the antibody or antigen-binding fragment binds human $Na_v1.7$, but does not bind monkey, mouse or rat $Na_v1.7$.

In one embodiment, the invention provides a fully human monoclonal antibody or antigen-binding fragment thereof that specifically binds human $Na_v1.7$ ($hNa_v1.7$) and neutralizes $hNa_v1.7$ activity, wherein the antibody or fragment thereof exhibits one or more of the following characteristics: (i) comprises a HCVR having an amino acid sequence selected from the group consisting of SEQ ID NO: 14, 18, 22, 30, 46, 50, 66, 70, 82, 86, 90, 94, 98, 102, 689, 693, 701, 705, 722, 727, 759, 860, 864, 868 and 872: (ii) comprises a LCVR having an amino acid sequence selected from the group consisting of SEQ ID NO: 16, 20, 24, 32, 48, 52, 68, 72, 84, 88, 92, 96, 100, 104, 691, 695, 703, 707, 724, 735, 767, 862, 866, 870 and 874; (iii) comprises any one or more of the heavy or light chain CDR1, CDR2, and CDR3 sequences depicted in Table 2 and combinations thereof; (iv) is specific for blocking $Na_v1.7$ activity without affecting other sodium channel activity, e.g. $Na_v1.5$; (v) demonstrates binding specificity for any one or more of the following regions of $hNa_v1.7$: extracellular loop 3 of domain I (designated EC3-1), comprising amino acid residues ranging from about residues 269-338 of SEQ ID NO: 670, or fragments thereof; or extracellular loop 3 of domain 3 (designated EC3-3), comprising amino acid residues ranging from about 1333-1382 of SEQ ID NO: 670, or fragments thereof; or the paddle region of $Na_v1.7$, comprising amino acid residues ranging from about residues 202-232 of SEQ ID NO: 670, or fragments thereof; (vi) binds any one or more of human, monkey, mouse or rat $Na_v1.7$, or (vii) blocks ion flux in cells containing $Na_v1.7$, resulting in blocking of transmembrane depolarization, as shown by any standard technique known to those skilled in the art, for example, use of a patch clamp method.

In one embodiment, the invention provides a fully human monoclonal antibody or antigen-binding fragment thereof that specifically binds human $Na_v1.7$ ($hNa_v1.7$) and neutralizes $hNa_v1.7$ activity, wherein the antibody or fragment thereof exhibits one or more of the following characteristics: (i) comprises a HCVR having an amino acid sequence selected from the group consisting of SEQ ID NO: 14, 18, 22, 30, 46, 50, 66, 70, 82, 86, 90, 94, 98, 102, 689, 693, 701, 705, 722, 727, 759, 860, 864, 868 and: (ii) comprises a LCVR having an amino acid sequence selected from the group consisting of SEQ ID NO: 16, 20, 24, 32, 48, 52, 68, 72, 84, 88, 92, 96, 100, 104, 691, 695, 703, 707, 724, 735, 767, 862, 866, 870 and 874; (iii) comprises any one or more of the heavy or light chain CDR1, CDR2, and CDR3 sequences depicted in Table 2 and combinations thereof; (iv) is capable of blocking $Na_v1.7$ activity in addition to certain other sodium channel activity, e.g. $Na_v1.8$ and/or $Na_v1.9$; (v) demonstrates binding specificity for any one or more of the following regions of $hNa_v1.7$: extracellular loop 3 of domain I (designated EC3-1), comprising amino acid residues ranging from about residues 269-338 of SEQ ID NO: 670, or fragments thereof; or extracellular loop 3 of domain 3 (designated EC3-3), comprising amino acid residues ranging from about 1333-1382 of SEQ ID NO: 670, or fragments thereof; or the paddle region of $Na_v1.7$, comprising amino acid residues ranging from about residues 202-232 of SEQ ID NO: 670, or fragments thereof, (vi) binds any one or more of human, monkey, mouse or rat $Na_v1.7$, or (vii) blocks ion flux in cells containing $Na_v1.7$, resulting in blocking of transmembrane depolarization, as shown by any standard technique known to those skilled in the art, for example, use of a patch clamp method.

In one embodiment, the invention provides an isolated antibody or antigen-binding fragment thereof that competes for specific binding to $hNa_v1.7$ with an antibody or antigen-binding fragment comprising heavy and light chain CDR domains contained within heavy and light chain sequence pairs selected from the group consisting of SEQ ID NO: 2/4, 6/8, 10/12, 14/16, 18/20, 22/24, 26/28, 30/32, 34/36, 38/40, 42/44, 46/48, 50/52, 54/56, 58/60, 62/64, 66/68, 70/72, 74/76, 78/80, 82/84, 86/88, 90/92, 94/96, 98/100, 102/104, 106/108, 110/112, 681/683, 685/687, 689/691, 693/695, 697/699, 701/703, 705/707, 709/711, 722/724, 727/735, 743/751, 759/767, 791/799, 807/815, 823/831, 860/862, 864/866, 868/870 and 872/874.

In one embodiment, the invention provides an isolated antibody or antigen-binding fragment thereof that binds the same epitope on $hNa_v1.7$ that is recognized by an antibody comprising heavy and light chain sequence pairs selected from the group consisting of SEQ ID NO: 2/4, 6/8, 10/12, 14/16, 18/20, 22/24, 26/28, 30/32, 34/36, 38/40, 42/44, 46/48, 50/52, 54/56, 58/60, 62/64, 66/68, 70/72, 74/76, 78/80, 82/84, 86/88, 90/92, 94/96, 98/100, 102/104, 106/108, 110/112, 681/683, 685/687, 689/691, 693/695, 697/

699, 701/703, 705/707, 709/711, 722/724, 727/735, 743/ 751, 759/767, 791/799, 807/815, 823/831, 860/862, 864/ 866, 868/870 and 872/874.

In a fifth aspect, the invention provides nucleic acid molecules encoding anti-Na$_v$1.7 antibodies or fragments thereof. Recombinant expression vectors carrying the nucleic acids of the invention, and host cells into which such vectors have been introduced, are also encompassed by the invention, as are methods of producing the antibodies by culturing the host cells under conditions permitting production of the antibodies, and recovering the antibodies produced.

In one embodiment, the invention provides an antibody or fragment thereof comprising a HCVR encoded by a nucleic acid sequence selected from the group consisting of SEQ ID NO: 1, 5, 9, 13, 17, 21, 25, 29, 33, 37, 41, 45, 49, 53, 57, 61, 65, 69, 73, 77, 81, 85, 89, 93, 97, 101, 105, 109, 680, 684, 688, 692, 696, 700, 704, 708, 721, 726, 742, 758, 790, 806, 822, 859, 863, 867, and 871 or a substantially identical sequence having at least 90%, at least 95%, at least 98%, or at least 99% homology thereof. In one embodiment, the HCVR is encoded by a nucleic acid sequence selected from the group consisting of SEQ ID NO: 13, 17, 21, 29, 45, 49, 65, 69, 81, 85, 89, 93, 97, 101, 688, 692, 700, 704, 721, 726, 758, 859, 863, 867 and 871.

In one embodiment, the antibody or fragment thereof further comprises a LCVR encoded by a nucleic acid sequence selected from the group consisting of SEQ ID NO: 3, 7, 11, 15, 19, 23, 27, 31, 35, 39, 43, 47, 51, 55, 59, 63, 67, 71, 75, 79, 83, 87, 91, 95, 99, 103, 107, 111, 682, 686, 690, 694, 698, 702, 706, 710, 723, 734, 750, 766, 782, 798, 814, 830, 861, 865, 869 and 873 or a substantially identical sequence having at least 90%, at least 95%, at least 98%, or at least 99% homology thereof. In one embodiment, the LCVR is encoded by a nucleic acid sequence selected from the group consisting of SEQ ID NO: 15, 19, 23, 31, 47, 51, 67, 71, 83, 87, 91, 95, 99, 103, 690, 694, 702, 706, 723, 734, 766, 861, 865, 869 and 873.

In one embodiment, the invention also provides an antibody or antigen-binding fragment of an antibody comprising a HCDR3 domain encoded by a nucleotide sequence located within the variable regions from any of the antibodies shown in Table 1, or a substantially similar sequence thereof having at least 90%, at least 95%, at least 98% or at least 99% sequence identity; and a LCDR3 domain encoded by a nucleotide sequence selected from any of those shown in Table 1, or a substantially similar sequence thereof having at least 90%, at least 95%, at least 98% or at least 99% sequence identity.

In one embodiment, the invention provides an antibody or fragment thereof further comprising a HCDR1 domain encoded by a nucleotide sequence of any of those shown in Table 1, or a substantially similar sequence thereof having at least 90%, at least 95%, at least 98% or at least 99% sequence identity; a HCDR2 domain encoded by a nucleotide sequence of any of those shown in Table 1, or a substantially similar sequence thereof having at least 90%, at least 95%, at least 98% or at least 99% sequence identity; a LCDR1 domain encoded by a nucleotide sequence of any of those shown in Table 1, or a substantially similar sequence thereof having at least 90%, at least 95%, at least 98% or at least 99% sequence identity; and a LCDR2 domain encoded by a nucleotide sequence shown in Table 1, or a substantially similar sequence thereof having at least 90%, at least 95%, at least 98% or at least 99% sequence identity.

In a sixth aspect, the invention features a human anti-hNa$_v$1.7 antibody or antigen-binding fragment of an antibody comprising a HCVR encoded by nucleotide sequence segments derived from V$_H$, D$_H$ and J$_H$ germline sequences, and a LCVR encoded by nucleotide sequence segments derived from V$_K$ and J$_K$ germline sequences, with combinations as shown in Table 3.

The invention encompasses anti-hNa$_v$1.7 antibodies having a modified glycosylation pattern. In some applications, modification to remove undesirable glycosylation sites may be useful, or e.g., removal of a fucose moiety to increase antibody dependent cellular cytotoxicity (ADCC) function (see Shield et al. (2002) JBC 277:26733). In other applications, modification of galactosylation can be made in order to modify complement dependent cytotoxicity (CDC).

In a seventh aspect, the invention features a pharmaceutical composition comprising a recombinant human antibody or fragment thereof, which specifically binds hNa$_v$1.7 and a pharmaceutically acceptable carrier. In one embodiment, the invention features a composition, which is a combination of an antibody or antigen-binding fragment of an antibody of the invention, and a second therapeutic agent. The second therapeutic agent may be any agent that is advantageously combined with the antibody or fragment thereof of the invention, for example, an agent capable of reducing pain, such as, but not limited to, opioids, COX-2 inhibitors, local anesthestics, NMDA modulators, cannabinoid receptor agonists, P2X family modulators, VR1 antagonists, and substance P antagonists. The second therapeutic agent may be an interleukin-1 (IL-1) inhibitor, for example, a fusion protein (U.S. Pat. No. 6,927,044); or an antiepileptic drug, such as gabapentin, pregabalin, topiramate; or a tricyclic antidepressant, such as amitriptyline; celecoxib; a cytokine inhibitor or antagonist, such as an antagonist to IL-6, IL-6R, IL-18 or IL-18R, or a Na$_v$1.8 inhibitor, a Na$_v$1.9 inhibitor, or a NGF inhibitor, or a second inhibitor or antagonist to Na$_v$1.7. The second therapeutic agent may be a small molecule drug or a protein/polypeptide inhibitor. The second therapeutic agent may be synthetic or naturally derived. The second therapeutic agent may be a second antibody specific for Na$_v$1.7, a polypeptide antagonist, a siRNA or an antisense molecule specific for Na$_v$1.7. It will also be appreciated that the antibodies and pharmaceutically acceptable compositions of the present invention can be employed in combination therapies, that is, the antibodies and pharmaceutically acceptable compositions can be administered concurrently with, prior to, or subsequent to, one or more other desired therapeutics or medical procedures. The particular combination of therapies (therapeutics or procedures) to employ in a combination regimen will take into account compatibility of the desired therapeutics and/or procedures and the desired therapeutic effect to be achieved. It will also be appreciated that the therapies employed may achieve a desired effect for the same disorder (for example, an antibody may be administered concurrently with another agent used to treat the same disorder), or they may achieve different effects (e.g., control of any adverse effects). As used herein, additional therapeutic agents that are normally administered to treat or prevent a particular disease, or condition, are appropriate for the disease, or condition, being treated.

In an eighth aspect, the invention features methods for inhibiting hNa$_v$1.7 activity using the anti-hNa$_v$1.7 antibody or antigen-binding portion of the antibody of the invention, wherein the therapeutic methods comprise administering a therapeutically effective amount of a pharmaceutical composition comprising an antibody or antigen-binding fragment thereof.

In one embodiment, the invention provides a therapeutic method for treating a $Na_v1.7$-related condition or disease, or the pain associated with the $Na_v1.7$-related condition or disease, the method comprising administering a $Na_v1.7$ antibody or antigen-binding fragment as described herein, to a patient in need thereof, such that the $Na_v1.7$-related condition or disease is mediated, or the pain associated with the condition or disease is alleviated or reduced.

In a related embodiment, the invention provides a pharmaceutical composition comprising any one or more anti-$Na_v1.7$ antibodies of the invention, or antigen-binding fragment thereof, for use in treating a $Na_v1.7$-related condition or disease, or the pain associated with the $Na_v1.7$-related condition or disease in a patient in need thereof, or at least one symptom or complication associated with the $Na_v1.7$-related condition or disease, wherein the $Na_v1.7$-related condition or disease, or the pain associated with the $Na_v1.7$-related condition or disease, or at least one symptom or complication associated with the $Na_v1.7$-related condition or disease, is prevented, ameliorated, or lessened in severity and/or duration.

In one embodiment, the invention provides use of a pharmaceutical composition comprising any one or more anti-$Na_v1.7$ antibodies of the invention, or antigen-binding fragments thereof, in the manufacture of a medicament for treating a $Na_v1.7$-related condition or disease, or the pain associated with the $Na_v1.7$-related condition or disease in a patient in need thereof, or at least one symptom or complication associated with the $Na_v1.7$-related condition or disease, wherein the $Na_v1.7$-related condition or disease, or the pain associated with the $Na_v1.7$-related condition or disease, or at least one symptom or complication associated with the $Na_v1.7$-related condition or disease, is prevented, ameliorated, or lessened in severity and/or duration.

The disorder treated is any disease or condition, which is improved, ameliorated, inhibited or prevented by removal, inhibition or reduction of $hNa_v1.7$ activity. Specific populations treatable by the therapeutic methods of the invention include a disease, disorder, or condition selected from acute, chronic, neuropathic, or inflammatory pain, arthritis, migraine, cluster headaches, trigeminal neuralgia, herpetic neuralgia, general neuralgias, epilepsy or epileptic conditions, myotonia, arrhythmia, movement disorders, neuroendocrine disorders, ataxia, irritable bowel syndrome, inflammatory bowel disease, faecal urgency, incontinence, rectal hypersensitivity, visceral pain, osteoarthritis pain, post-herpetic neuralgia, diabetic neuropathy, radicular pain, sciatica, back pain, head or neck pain, breakthrough pain, post-surgical pain, or cancer pain. Other conditions treatable by the therapeutic methods of the invention include hereditary erythromelalgia, rhinitis, prostate cancer, breast cancer, cervical cancer, or bladder disorders. The antibodies of the invention or antigen-binding fragments thereof may also be used to treat the following conditions: non-malignant acute, chronic, or fracture bone pain; rheumatoid arthritis, spinal stenosis; neuropathic low back pain; myofascial pain syndrome; fibromyalgia; temporomandibular joint pain; pancreatic; chronic headache pain; tension headache, including, cluster headaches; diabetic neuropathy; HIV-associated neuropathy; Charcot-Marie Tooth neuropathy; hereditary sensory neuropathies; peripheral nerve injury; painful neuromas; ectopic proximal and distal discharges; radiculopathy; chemotherapy induced neuropathic pain; radiotherapy-induced neuropathic pain; post-mastectomy pain; central pain; spinal cord injury pain; post-stroke pain; thalamic pain; complex regional pain syndrome; phantom pain; intractable pain; acute musculoskeletal pain; joint pain; acute gout pain; mechanical low back pain; neck pain; tendonitis; injury/exercise pain; abdominal pain; pyelonephritis; appendicitis; cholecystitis; intestinal obstruction; hernias; etc; chest pain, including, cardiac pain; pelvic pain, renal colic pain, acute obstetric pain, including, labor pain; cesarean section pain; burn and trauma pain; endometriosis; herpes zoster pain; sickle cell anemia; acute pancreatitis; breakthrough pain; orofacial pain including sinusitis pain, dental pain; multiple sclerosis pain; leprosy pain; Behcet's disease pain; adiposis dolorosa; phlebitic pain; Guillain-Barre pain; painful legs and moving toes; Haglund syndrome; Fabry's disease pain; bladder and urogenital disease; hyperactivity bladder; painful bladder syndrome; interstitial cyctitis; or prostatitis. The antibodies of the invention or antigen-binding fragments thereof may also be used to inhibit tumor cell proliferation or metastasis of tumor cells, such as in prostate, breast and cervical cancers.

Other embodiments will become apparent from a review of the ensuing detailed description.

DETAILED DESCRIPTION

Figure 1:
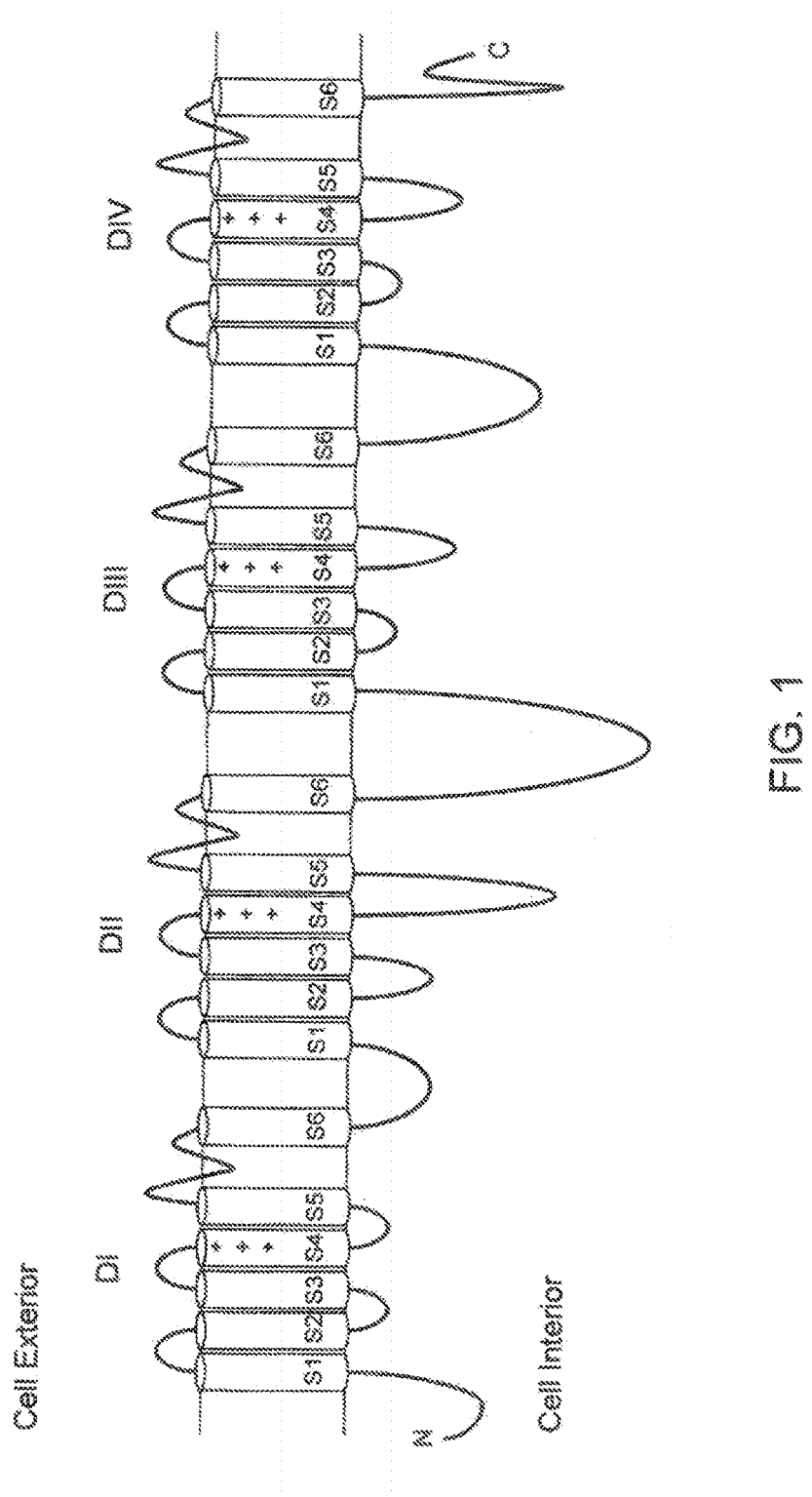
FIG. 1—Shows a diagram of a $Na_v$ channel.

Before the present methods are described, it is to be understood that this invention is not limited to particular methods, and experimental conditions described, as such methods and conditions may vary. It is also to be understood that the terminology used herein is for the purpose of describing particular embodiments only, and is not intended to be limiting, since the scope of the present invention will be limited only by the appended claims.

Unless defined otherwise, all technical and scientific terms used herein have the same meaning as commonly understood by one of ordinary skill in the art to which this invention belongs. Although any methods and materials similar or equivalent to those described herein can be used in the practice or testing of the present invention, preferred methods and materials are now described. All publications mentioned herein are incorporated herein by reference in their entirety.

Definitions

"$Na_v1.7$," or "Nav1.7", as used herein, refers to an isoform of a voltage-gated sodium channel (VGSC) known in the art by names such as ETHA, FEB3B, NE-NA, hNE-Na, Nav1.7, PN1, NaS, sodium channel protein type 9 subunit alpha, sodium channel protein type IX subunit alpha, and voltage-gated sodium channel subunit alpha Nav1.7. The gene encoding the $Na_v1.7$ sodium channel is designated SCN9A. The expression "$Na_v1.7$," "Nav1.7", "$hNa_v1.7$," or "hNav1.7", or fragments thereof, as used herein, refers to the human Nav1.7 protein or fragment thereof, unless specified as being from a non-human species, e.g. "mouse Nav1.7", "rat Nav1.7", or "monkey Nav1.7". Moreover, "Na$_v$1.7," or "Nav1.7", as used herein, refers to human Na$_v$1.7 having the nucleic acid sequence shown in SEQ ID NO: 669 (Genbank accession number DQ857292; NM_002977.3; X82835) and the amino acid sequence of SEQ ID NO: 670 (Genbank accession number ABI51981; NP_002968; CAA58042), or a biologically active fragment thereof. The α-subunit of Na$_v$1.7 has four repeat domains, I through IV (also referred to as A, B, C and D, or 1, 2, 3 and 4), each containing six membrane-spanning regions, labeled 51 through S6. Domain I spans residues 1-728 of SEQ ID NO: 670; domain II spans residues 729-1176 of SEQ ID NO: 670; domain III spans residues 1177-1494 of SEQ ID NO: 670; and domain IV spans residues 1495-1977 of SEQ ID NO: 670. As used herein, the extracellular regions of Na$_v$1.7 that may be useful for preparing Na$_v$1.7 specific antibodies that bind Na$_v$1.7 and inhibit its function include the regions referred to as "extracellular (EC) loop 3-1" (loop 3, domain 1, designated "EC 3-1", from residue number 269 to 338 of SEQ ID NO: 670); "EC loop number 3-2" (loop 3, domain 2, designated "EC 3-2", residue number 874 to 932 of SEQ ID NO: 670); "EC loop 3-3" (loop 3, domain 3, designated "EC 3-3", from residue number 1333 to 1382 of SEQ ID NO: 670); or "EC loop number 3-4" (loop 3, domain 4, designated "EC 3-4", residue number 1659 to 1723 of SEQ ID NO: 670). The "paddle region 2-1", as used herein, extends from residue number 202 to 232 of SEQ ID NO: 670 and may also be used in the present invention for preparation of antibodies useful for inhibiting the function of Nav1.7. There are a variety of other sequences related to the Na$_v$1.7 gene having the following Genbank Accession Numbers: NM 002977 (human), U35238 (rabbit), X82835 (human), U79568 (rat), and AF000368 (rat). Furthermore, the exact amino acid sequence for each of the extracellular regions and/or domains may vary depending on the database entry employed, for example, UniProtKB/Swiss-Prot may provide information for Na$_v$1.7 which may vary slightly from the sequences disclosed herein. These nucleic acid sequences, the polypeptides encoded by them, and other nucleic acid and polypeptide sequences are herein incorporated by reference in their entireties as well as for individual subsequences contained therein.

The term "antibody", as used herein, is intended to refer to immunoglobulin molecules comprised of four polypeptide chains, two heavy (H) chains and two light (L) chains inter-connected by disulfide bonds (i.e., "full antibody molecules"), as well as multimers thereof (e.g. IgM) or antigen-binding fragments thereof. Each heavy chain is comprised of a heavy chain variable region ("HCVR" or "V$_H$") and a heavy chain constant region (comprised of domains C$_H$1, C$_H$2 and C$_H$3). Each light chain is comprised of a light chain variable region ("LCVR or "V$_L$") and a light chain constant region (C$_L$). The V$_H$ and V$_L$ regions can be further subdivided into regions of hypervariability, termed complementarity determining regions (CDR), interspersed with regions that are more conserved, termed framework regions (FR). Each V$_H$ and V$_L$ is composed of three CDRs and four FRs, arranged from amino-terminus to carboxy-terminus in the following order: FR1, CDR1, FR2, CDR2, FR3, CDR3, FR4. In certain embodiments of the invention, the FRs of the anti-Na$_v$1.7 antibody (or antigen binding fragment thereof) may be identical to the human germline sequences, or may be naturally or artificially modified. An amino acid consensus sequence may be defined based on a side-by-side analysis of two or more CDRs.

Substitution of one or more CDR residues or omission of one or more CDRs is also possible. Antibodies have been described in the scientific literature in which one or two CDRs can be dispensed with for binding. Padlan et al. (1995 FASEB J. 9:133-139) analyzed the contact regions between antibodies and their antigens, based on published crystal structures, and concluded that only about one fifth to one third of CDR residues actually contact the antigen. Padlan also found many antibodies in which one or two CDRs had no amino acids in contact with an antigen (see also, Vajdos et al. 2002 J Mol Biol 320:415-428).

CDR residues not contacting antigen can be identified based on previous studies (for example residues H60-H65 in CDRH2 are often not required), from regions of Kabat CDRs lying outside Chothia CDRs, by molecular modeling and/or empirically. If a CDR or residue(s) thereof is omitted, it is usually substituted with an amino acid occupying the corresponding position in another human antibody sequence or a consensus of such sequences. Positions for substitution within CDRs and amino acids to substitute can also be selected empirically. Empirical substitutions can be conservative or non-conservative substitutions.

The fully-human anti-hNa$_v$1.7 antibodies disclosed herein may comprise one or more amino acid substitutions, insertions and/or deletions in the framework and/or CDR regions of the heavy and light chain variable domains as compared to the corresponding germline sequences. Such mutations can be readily ascertained by comparing the amino acid sequences disclosed herein to germline sequences available from, for example, public antibody sequence databases. The present invention includes antibodies, and antigen-binding fragments thereof, which are derived from any of the amino acid sequences disclosed herein, wherein one or more amino acids within one or more framework and/or CDR regions are back-mutated to the corresponding germline residue(s) or to a conservative amino acid substitution (natural or non-natural) of the corresponding germline residue(s) (such sequence changes are referred to herein as "germline back-mutations"). A person of ordinary skill in the art, starting with the heavy and light chain variable region sequences disclosed herein, can easily produce numerous antibodies and antigen-binding fragments which comprise one or more individual germline back-mutations or combinations thereof. In certain embodiments, all of the framework and/or CDR residues within the V$_H$ and/or V$_L$ domains are mutated back to the germline sequence. In other embodiments, only certain residues are mutated back to the germline sequence, e.g., only the mutated residues found within the first 8 amino acids of FR1 or within the last 8 amino acids of FR4, or to germline back-mutations within all framework regions FR1, FR2, FR3, FR4, or only the mutated residues found within CDR1, CDR2 or CDR3. Furthermore, the antibodies of the present invention may contain any combination of two or more germline back-mutations within the framework and/or CDR regions, i.e., wherein certain individual residues are mutated back to the germline sequence while certain other residues that differ from the germline sequence are maintained. Once obtained, antibodies and antigen-binding fragments that contain one or more germline back-mutations can be easily tested for one or more desired property such as, improved binding specificity, increased binding affinity, improved or enhanced antagonistic or agonistic biological properties (as the case may be), reduced immunogenicity, etc. Antibodies and antigen-binding fragments obtained in this general manner are encompassed within the present invention.

The term "human antibody", as used herein, is intended to include antibodies having variable and constant regions derived from human germline immunoglobulin sequences. The human mAbs of the invention may include amino acid residues not encoded by human germline immunoglobulin sequences (e.g., mutations introduced by random or site-specific mutagenesis in vitro or by somatic mutation in vivo), for example in the CDRs and in particular CDR3. However, the term "human antibody", as used herein, is not intended to include mAbs in which CDR sequences derived from the germline of another mammalian species (e.g., mouse), have been grafted onto human FR sequences. The anti-human $Na_v1.7$ antibodies of the invention may be designated as "anti-hNav1.7" or "anti-h$Na_v$1.7".

The term "specifically binds," or the like, means that an antibody or antigen-binding fragment thereof forms a complex with an antigen that is relatively stable under physiologic conditions. Specific binding can be characterized by an equilibrium dissociation constant of at least about $1 \times 10^{-6}$ M or less (e.g., a smaller $K_D$ denotes a tighter binding). Methods for determining whether two molecules specifically bind are well known in the art and include, for example, equilibrium dialysis, surface plasmon resonance, and the like. An isolated antibody that specifically binds h$Na_v$1.7 may, however, exhibit cross-reactivity to other antigens such as $Na_v$1.7 molecules from other species. Moreover, multi-specific antibodies that bind to h$Na_v$1.7 and one or more additional antigens or a bi-specific that binds to two different regions of h$Na_v$1.7 (e.g. EC loop 3-1 and EC loop 3-3) are nonetheless considered antibodies that "specifically bind" h$Na_v$1.7, as used herein.

As used herein, the term "does not bind" to a specified target molecule (e.g. a particular $Na_v$1.7 peptide) means that the antibody, when tested for binding to the target molecule at 25° C. in a Plasmon resonance assay, exhibits a $K_D$ of greater than 500 nM, or if tested for binding to the target molecule at 25° C. in an enzyme linked immunosorbent assay (ELISA) exhibits an $EC_{50}$ of greater than 50 nM, or fails to exhibit any binding in either type of assay or equivalent thereof.

The term "high affinity" antibody refers to those mAbs having a binding affinity to h$Na_v$1.7 of at least $10^{-9}$ M; preferably $10^{-10}$ M; more preferably $10^{-11}$M, even more preferably $10^{-12}$ M, as measured by surface plasmon resonance, e.g., BIACORE™ or solution-affinity ELISA.

By the term "slow off rate", "Koff" or "kd" is meant an antibody that dissociates from hNAV1.7 with a rate constant of $1 \times 10^{-3}$ $s^{-1}$ or less, preferably $1 \times 10^{-4}$ $s^{-1}$ or less, as determined by surface plasmon resonance, e.g., BIACORE™.

The terms "antigen-binding portion" of an antibody, "antigen-binding fragment" of an antibody, and the like, as used herein, include any naturally occurring, enzymatically obtainable, synthetic, or genetically engineered polypeptide or glycoprotein that specifically binds an antigen to form a complex. The terms "antigen-binding portion" of an antibody, or "antibody fragment", as used herein, refers to one or more fragments of an antibody that retain the ability to specifically bind to h$Na_v$1.7.

The specific embodiments, antibody or antibody fragments of the invention may be conjugated to a therapeutic moiety ("immunoconjugate"), such as an opioid, a COX-2 inhibitor, a local anesthestic, a cytokine antagonist, such as an IL-1 or IL-6 inhibitor, a second $Na_v$1.7 inhibitor, an NMDA modulator, a cannabinoid receptor agonist, a P2X family modulator, a VR1 antagonist, a substance P antagonist, a chemotherapeutic agent, or a radioisotope.

An "isolated antibody", as used herein, is intended to refer to an antibody that is substantially free of other antibodies (Abs) having different antigenic specificities (e.g., an isolated antibody that specifically binds h$Na_v$1.7, or a fragment thereof, is substantially free of Abs that specifically bind antigens other than h$Na_v$1.7).

A "neutralizing antibody", as used herein (or an "antibody that neutralizes $Na_v$1.7 activity"), is intended to refer to an antibody whose binding to h$Na_v$1.7 results in inhibition of at least one biological activity of $Na_v$1.7. This inhibition of the biological activity of $Na_v$1.7 can be assessed by measuring one or more indicators of $Na_v$1.7 biological activity by one or more of several standard in vitro or in vivo assays known in the art (see examples below).

The term "surface plasmon resonance", as used herein, refers to an optical phenomenon that allows for the analysis of real-time biomolecular interactions by detection of alterations in protein concentrations within a biosensor matrix, for example using the BIACORE™ system (Pharmacia Biosensor AB, Uppsala, Sweden and Piscataway, N.J.).

The term "$K_D$", as used herein, is intended to refer to the equilibrium dissociation constant of a particular antibody-antigen interaction.

The term "epitope" refers to an antigenic determinant that interacts with a specific antigen binding site in the variable region of an antibody molecule known as a paratope. A single antigen may have more than one epitope. Thus, different antibodies may bind to different areas on an antigen and may have different biological effects. The term "epitope" also refers to a site on an antigen to which B and/or T cells respond. It also refers to a region of an antigen that is bound by an antibody. Epitopes may be defined as structural or functional. Functional epitopes are generally a subset of the structural epitopes and have those residues that directly contribute to the affinity of the interaction. Epitopes may also be conformational, that is, composed of non-linear amino acids. In certain embodiments, epitopes may include determinants that are chemically active surface groupings of molecules such as amino acids, sugar side chains, phosphoryl groups, or sulfonyl groups, and, in certain embodiments, may have specific three-dimensional structural characteristics, and/or specific charge characteristics.

The term "substantial identity" or "substantially identical," when referring to a nucleic acid or fragment thereof, indicates that, when optimally aligned with appropriate nucleotide insertions or deletions with another nucleic acid (or its complementary strand), there is nucleotide sequence identity in at least about 90%, and more preferably at least about 95%, 96%, 97%, 98% or 99% of the nucleotide bases, as measured by any well-known algorithm of sequence identity, such as FASTA, BLAST or GAP, as discussed below. A nucleic acid molecule having substantial identity to a reference nucleic acid molecule may, in certain instances, encode a polypeptide having the same or substantially similar amino acid sequence as the polypeptide encoded by the reference nucleic acid molecule.

As applied to polypeptides, the term "substantial similarity" or "substantially similar" means that two peptide sequences, when optimally aligned, such as by the programs GAP or BESTFIT using default gap weights, share at least 90% sequence identity, even more preferably at least 95%, 98% or 99% sequence identity. Preferably, residue positions, which are not identical, differ by conservative amino acid substitutions. A "conservative amino acid substitution" is one in which an amino acid residue is substituted by another amino acid residue having a side chain (R group) with similar chemical properties (e.g., charge or hydrophobicity).

In general, a conservative amino acid substitution will not substantially change the functional properties of a protein. In cases where two or more amino acid sequences differ from each other by conservative substitutions, the percent or degree of similarity may be adjusted upwards to correct for the conservative nature of the substitution. Means for making this adjustment are well known to those of skill in the art. See, e.g., Pearson (1994) Methods Mol. Biol. 24: 307-331, which is herein incorporated by reference. Examples of groups of amino acids that have side chains with similar chemical properties include 1) aliphatic side chains: glycine, alanine, valine, leucine and isoleucine; 2) aliphatic-hydroxyl side chains: serine and threonine; 3) amide-containing side chains: asparagine and glutamine; 4) aromatic side chains: phenylalanine, tyrosine, and tryptophan; 5) basic side chains: lysine, arginine, and histidine; 6) acidic side chains: aspartate and glutamate, and 7) sulfur-containing side chains: cysteine and methionine. Preferred conservative amino acids substitution groups are: valine-leucine-isoleucine, phenylalanine-tyrosine, lysine-arginine, alanine-valine, glutamate-aspartate, and asparagine-glutamine. Alternatively, a conservative replacement is any change having a positive value in the PAM250 log-likelihood matrix disclosed in Gonnet et al. (1992) Science 256: 1443 45, herein incorporated by reference. A "moderately conservative" replacement is any change having a nonnegative value in the PAM250 log-likelihood matrix.

Sequence similarity for polypeptides is typically measured using sequence analysis software. Protein analysis software matches similar sequences using measures of similarity assigned to various substitutions, deletions and other modifications, including conservative amino acid substitutions. For instance, GCG software contains programs such as GAP and BESTFIT which can be used with default parameters to determine sequence homology or sequence identity between closely related polypeptides, such as homologous polypeptides from different species of organisms or between a wild type protein and a mutein thereof. See, e.g., GCG Version 6.1. Polypeptide sequences also can be compared using FASTA with default or recommended parameters; a program in GCG Version 6.1. FASTA (e.g., FASTA2 and FASTA3) provides alignments and percent sequence identity of the regions of the best overlap between the query and search sequences (Pearson (2000) supra). Another preferred algorithm when comparing a sequence of the invention to a database containing a large number of sequences from different organisms is the computer program BLAST, especially BLASTP or TBLASTN, using default parameters. See, e.g., Altschul et al. (1990) J. Mol. Biol. 215: 403 410 and (1997) Nucleic Acids Res. 25:3389 402, each of which is herein incorporated by reference.

In specific embodiments, the antibody or antibody fragment for use in the method of the invention may be mono-specific, bi-specific, or multi-specific. Multi-specific antibodies may be specific for different epitopes of one target polypeptide or may contain antigen-binding domains specific for epitopes of more than one target polypeptide. An exemplary bi-specific antibody format that can be used in the context of the present invention involves the use of a first immunoglobulin (Ig) $C_H3$ domain and a second Ig $C_H3$ domain, wherein the first and second Ig $C_H3$ domains differ from one another by at least one amino acid, and wherein at least one amino acid difference reduces binding of the bi-specific antibody to Protein A as compared to a bi-specific antibody lacking the amino acid difference. In one embodiment, the first Ig $C_H3$ domain binds Protein A and the second Ig $C_H3$ domain contains a mutation that reduces or abolishes Protein A binding such as an H95R modification (by IMGT exon numbering; H435R by EU numbering). The second $C_H3$ may further comprise an Y96F modification (by IMGT; Y436F by EU). Further modifications that may be found within the second $C_H3$ include: D16E, L18M, N44S, K52N, V57M, and V82I (by IMGT; D356E, L358M, N384S, K392N, V397M, and V422I by EU) in the case of IgG1 mAbs; N44S, K52N, and V82I (IMGT; N384S, K392N, and V422I by EU) in the case of IgG2 mAbs; and Q15R, N44S, K52N, V57M, R69K, E79Q, and V82I (by IMGT; Q355R, N384S, K392N, V397M, R409K, E419Q, and V422I by EU) in the case of IgG4 mAbs. Variations on the bi-specific antibody format described above are contemplated within the scope of the present invention.

By the phrase "therapeutically effective amount" is meant an amount that produces the desired effect for which it is administered. The exact amount will depend on the purpose of the treatment, and will be ascertainable by one skilled in the art using known techniques (see, for example, Lloyd (1999) The Art, Science and Technology of Pharmaceutical Compounding).

General Description

Voltage-gated sodium channels (VGSCs) are typically a complex of various subunits, the principle one being the alpha-subunit, which is the pore-forming subunit. The alpha-subunit alone is sufficient for all known sodium channel function. However, in certain sodium channels there are smaller, auxiliary subunits called beta-subunits, which are known to associate with the larger alpha-subunit and are believed to modulate some of the functions of the alpha-subunit. (See Kraner, et al. (1985) J Biol Chem 260:6341-6347; Tanaka, et al. (1983) J Biol Chem 258:7519-7526; Hartshorne, et al. (1984) J Biol Chem 259:1667-1675; Catterall, (1992) Physiol Rev 72:S14-S48; Anderson, et al. (1992) Physiol Rev 72:S89-S158.) A review of sodium channels is presented in Catterall, (1995) Ann Rev Biochem 64:493-531).

The alpha-subunit of a sodium channel is a large glycoprotein containing four homologous repeat domains (labeled I-IV) connected by intracellular loops (Alberts, et al., eds, "Molecular Biology of the Cell" 534-535, Garland Pub., New York, N.Y. (1994)), with each domain containing six membrane-spanning segments (labeled S1-S6). The pore loop lies between segment 5 (S5) and segment 6 (S6). Segment 4 (S4) is the voltage "sensor"/ligand binding domain. The "paddle region" is located between segments S3b and S4. Extracellular loops connect segment 1 (S1) to segment 2 (S2), segment 3 (S3) to segment 4 (S4), and S5 to S6. Intracellular loops connect S2 to S3 and S4 to S5 (S5) (See Agnew, et al. (1978) Proc Natl Acad Sci USA 75:2606-2610; Agnew, et al. (1980) Biochem Biophys Res Comm 92:860-866; Catterall, (1986) Ann Rev Biochem 55:953-985; Catterall, (1992) Physiol Rev 72:S14-S48).

The $Na_v1.7$ VGSC is sensitive to blocking by tetrodotoxin (TTX) and is preferentially expressed in peripheral sympathetic and sensory neurons. The SCN9A gene encoding $Na_v1.7$ has been cloned from a number of species, including human, rat, and rabbit and shows 90% amino acid identity between the human and rat genes (Toledo-Aral et al., Proc. Natl. Acad. Sci. USA, 94(4): 1527-1532 (1997)). The structure and functional expression of hNav1.7 has been described by Klugbauer et al. (Klugbauer, N. et al. (1995) The EMBO Journal 14 (6):1084-1090).

In certain embodiments of the present invention, any one or more of the domains (I, II, III, or IV, also referred to as domains 1, 2, 3 and 4) of $Na_v1.7$, or any one or more of the extracellular loops (or fragments thereof) within any of the domains of Na$_v$1.7 may be used to prepare antibodies that bind Na$_v$1.7 and inhibit its function. The full-length amino acid sequence of human Na$_v$1.7 is shown as SEQ ID NO: 670. Domain I spans residues 1-728 of SEQ ID NO: 670; domain II spans residues 729-1176 of SEQ ID NO: 670; domain III spans residues 1177-1494 of SEQ ID NO: 670; and domain IV spans residues 1495-1977 of SEQ ID NO: 670. In one embodiment, the regions of Na$_v$1.7 that may be useful for preparing Na$_v$1.7 specific antibodies that bind Na$_v$1.7 and inhibit its function include the regions referred to as "extracellular (EC) loop 3-1" (loop 3, domain 1, designated "EC 3-1", from residue number 269 to 338 of SEQ ID NO: 670); or "EC loop 3-3" (loop 3, domain 3, designated "EC 3-3", from residue number 1333 to 1382 of SEQ ID NO: 670); or the "paddle region 2-1" (from residue number 202 to 232 of SEQ ID NO: 670). In certain embodiments, the regions of interest for use in the preparation of inhibitory antibodies to Na$_v$1.7 may be selected from "EC loop number 3-2" (loop 3, domain 2, designated "EC 3-2", residue number 874 to 932 of SEQ ID NO: 670) and "EC loop number 3-4" (loop 3, domain 4, designated "EC 3-4", residue number 1659 to 1723 of SEQ ID NO: 670). In certain embodiments, antibodies that bind specifically to Na$_v$1.7 may be prepared using fragments of the above-noted loop or paddle regions, or peptides that extend beyond the designated regions by about 10 to about 50 amino acid residues from either, or both, the N or C terminal ends of the regions described herein, for example, residue numbers ranging from about 202-215 of the paddle region contained within SEQ ID NO: 670; or from about residue 206-211 of the paddle region contained within SEQ ID NO: 670; residues ranging from about 269-310 of EC loop 3-1 contained within SEQ ID NO: 670; residues ranging from about 269-326 of EC loop 3-1 contained within SEQ ID NO: 670; residues ranging from about 272-310 of EC loop 3-1 contained within SEQ ID NO: 670; residues ranging from about 272-378 of EC loop 3-1 contained within SEQ ID NO: 670; residues ranging from about 1333-1375 of EC loop 3-3 contained within SEQ ID NO: 670; or residues ranging from about 1341-1419 of EC loop 3-3 contained within SEQ ID NO: 670. In certain embodiments, any combination of the above-noted regions or fragments thereof may be used in the preparation of Na$_v$1.7 specific antibodies. As noted above, the length, or the number of amino acid residues encompassing the EC loops or paddle region of hNa$_v$1.7 may vary by about ten to fifty amino acid residues extending from either, or both, the N terminal or C terminal end of the full length EC loop or paddle region, or a fragment thereof, for preparation of anti-hNa$_v$1.7 specific antibodies. For example, the number of amino acid residues encompassing the paddle region 2-1 may extend from about twenty amino acid residues from either, or both, the N or C terminal end of the region as described herein as SEQ ID NO: 679. In addition, the number of amino acid residues encompassing the EC loop 3-1 may range from about forty amino acid residues from either, or both, the N or C terminal end of the region as described herein as SEQ ID NO: 678. Furthermore, the number of amino acid residues encompassing EC loop 3-3 may range from about fifty amino acid residues from either, or both, the N or C terminal end of the region as described herein as SEQ ID NO: 725. In certain embodiments, any one or more of the above-noted regions of Na$_v$1.7, or fragments thereof may be used for preparing monospecific, bispecific, or multispecific antibodies.

Antigen-Binding Fragments of Antibodies

Unless specifically indicated otherwise, the term "antibody," as used herein, shall be understood to encompass antibody molecules comprising two immunoglobulin heavy chains and two immunoglobulin light chains (i.e., "full antibody molecules") as well as antigen-binding fragments thereof. The terms "antigen-binding portion" of an antibody, "antigen-binding fragment" of an antibody, and the like, as used herein, include any naturally occurring, enzymatically obtainable, synthetic, or genetically engineered polypeptide or glycoprotein that specifically binds an antigen to form a complex. The terms "antigen-binding portion" of an antibody, or "antibody fragment", as used herein, refers to one or more fragments of an antibody that retain the ability to specifically bind to hNA$_v$1.7. An antibody fragment may include a Fab fragment, a F(ab')$_2$ fragment, a Fv fragment, a dAb fragment, a fragment containing a CDR, or an isolated CDR. Antigen-binding fragments of an antibody may be derived, e.g., from full antibody molecules using any suitable standard techniques such as proteolytic digestion or recombinant genetic engineering techniques involving the manipulation and expression of DNA encoding antibody variable and (optionally) constant domains. Such DNA is known and/or is readily available from, e.g., commercial sources, DNA libraries (including, e.g., phage-antibody libraries), or can be synthesized. The DNA may be sequenced and manipulated chemically or by using molecular biology techniques, for example, to arrange one or more variable and/or constant domains into a suitable configuration, or to introduce codons, create cysteine residues, modify, add or delete amino acids, etc.

Non-limiting examples of antigen-binding fragments include: (i) Fab fragments; (ii) F(ab')$_2$ fragments; (iii) Fd fragments; (iv) Fv fragments; (v) single-chain Fv (scFv) molecules; (vi) dAb fragments; and (vii) minimal recognition units consisting of the amino acid residues that mimic the hypervariable region of an antibody (e.g., an isolated complementarity determining region (CDR)). Other engineered molecules, such as diabodies, triabodies, tetrabodies and minibodies, are also encompassed within the expression "antigen-binding fragment," as used herein.

An antigen-binding fragment of an antibody will typically comprise at least one variable domain. The variable domain may be of any size or amino acid composition and will generally comprise at least one CDR, which is adjacent to or in frame with one or more framework sequences. In antigen-binding fragments having a $V_H$ domain associated with a $V_L$ domain, the $V_H$ and $V_L$ domains may be situated relative to one another in any suitable arrangement. For example, the variable region may be dimeric and contain $V_H$-$V_H$, $V_H$-$V_L$ or $V_L$-$V_L$ dimers. Alternatively, the antigen-binding fragment of an antibody may contain a monomeric $V_H$ or $V_L$ domain.

In certain embodiments, an antigen-binding fragment of an antibody may contain at least one variable domain covalently linked to at least one constant domain. Non-limiting, exemplary configurations of variable and constant domains that may be found within an antigen-binding fragment of an antibody of the present invention include: (i) $V_H$-$C_H$1; (ii) $V_H$-$C_H$2; (iii) $V_H$-$C_H$3; (iv) $V_H$-$C_H$1-$C_H$2; (V) $V_H$-$C_H$1-$C_H$2-$C_H$3; (Vi) $V_H$-$C_H$2-$C_H$3; (Vii) $V_H$-$C_L$; (viii) $V_H$-$C_H$1; (ix) $V_L$-$C_H$2; (X) $V_L$-$C_H$3; (xi) $V_L$-$C_H$1-$C_H$2; (XII) $V_L$-$C_H$1-$C_H$2-$C_H$3; (Xiii) $V_L$-$C_H$2-$C_H$3; and (xiv) $V_L$-$C_L$. In any configuration of variable and constant domains, including any of the exemplary configurations listed above, the variable and constant domains may be either directly linked to one another or may be linked by a full or partial hinge or linker region. A hinge region may consist of at least 2 (e.g., 5, 10, 15, 20, 40, 60 or more) amino acids, which result in a flexible or semi-flexible linkage between adjacent variable and/or constant domains in a single polypeptide molecule. Moreover, an antigen-binding fragment of an antibody of the present invention may comprise a homo-dimer or hetero-dimer (or other multimer) of any of the variable and constant domain configurations listed above in non-covalent association with one another and/or with one or more monomeric $V_H$ or $V_L$ domain (e.g., by disulfide bond(s)).

As with full antibody molecules, antigen-binding fragments may be mono-specific or multi-specific (e.g., bi-specific). A multi-specific antigen-binding fragment of an antibody will typically comprise at least two different variable domains, wherein each variable domain is capable of specifically binding to a separate antigen or to a different epitope on the same antigen. Any multi-specific antibody format, including the exemplary bi-specific antibody formats disclosed herein, may be adapted for use in the context of an antigen-binding fragment of an antibody of the present invention using routine techniques available in the art.

Preparation of Human Antibodies

Methods for generating human antibodies in transgenic mice are known in the art. Any such known methods can be used in the context of the present invention to make human antibodies that specifically bind to human $Na_v1.7$.

Using VELOCIMMUNE™ technology or any other known method for generating monoclonal antibodies, high affinity chimeric antibodies to $Na_v1.7$ are initially isolated having a human variable region and a mouse constant region. As in the experimental section below, the antibodies are characterized and selected for desirable characteristics, including affinity, selectivity, epitope, etc. The mouse constant regions are replaced with a desired human constant region to generate the fully human antibody of the invention, for example wild-type or modified IgG1 or IgG4. While the constant region selected may vary according to specific use, high affinity antigen-binding and target specificity characteristics reside in the variable region.

In general, the antibodies of the instant invention possess very high affinities, typically possessing $K_D$ of from about $10^{-12}$ through about $10^{-9}$ M, when measured by binding to antigen either immobilized on solid phase or in solution phase. The mouse constant regions are replaced with desired human constant regions to generate the fully human antibodies of the invention. While the constant region selected may vary according to specific use, high affinity antigen-binding and target specificity characteristics reside in the variable region.

Bioequivalents

The anti-$Na_v1.7$ antibodies and antibody fragments of the present invention encompass proteins having amino acid sequences that vary from those of the described antibodies, but that retain the ability to bind human $Na_v1.7$. Such variant antibodies and antibody fragments comprise one or more additions, deletions, or substitutions of amino acids when compared to parent sequence, but exhibit biological activity that is essentially equivalent to that of the described antibodies. Likewise, the anti-$Na_v1.7$ antibody-encoding DNA sequences of the present invention encompass sequences that comprise one or more additions, deletions, or substitutions of nucleotides when compared to the disclosed sequence, but that encode an anti-$Na_v1.7$ antibody or antibody fragment that is essentially bioequivalent to an anti-$Na_v1.7$ antibody or antibody fragment of the invention.

Two antigen-binding proteins, or antibodies, are considered bioequivalent if, for example, they are pharmaceutical equivalents or pharmaceutical alternatives whose rate and extent of absorption do not show a significant difference when administered at the same molar dose under similar experimental conditions, either single does or multiple dose. Some antibodies will be considered equivalents or pharmaceutical alternatives if they are equivalent in the extent of their absorption but not in their rate of absorption and yet may be considered bioequivalent because such differences in the rate of absorption are intentional and are reflected in the labeling, are not essential to the attainment of effective body drug concentrations on, e.g., chronic use, and are considered medically insignificant for the particular drug product studied.

In one embodiment, two antigen-binding proteins are bioequivalent if there are no clinically meaningful differences in their safety, purity, and potency.

In one embodiment, two antigen-binding proteins are bioequivalent if a patient can be switched one or more times between the reference product and the biological product without an expected increase in the risk of adverse effects, including a clinically significant change in immunogenicity, or diminished effectiveness, as compared to continued therapy without such switching.

In one embodiment, two antigen-binding proteins are bioequivalent if they both act by a common mechanism or mechanisms of action for the condition or conditions of use, to the extent that such mechanisms are known.

Bioequivalence may be demonstrated by in vivo and/or in vitro methods. Bioequivalence measures include, e.g., (a) an in vivo test in humans or other mammals, in which the concentration of the antibody or its metabolites is measured in blood, plasma, serum, or other biological fluid as a function of time; (b) an in vitro test that has been correlated with and is reasonably predictive of human in vivo bioavailability data; (c) an in vivo test in humans or other mammals in which the appropriate acute pharmacological effect of the antibody (or its target) is measured as a function of time; and (d) in a well-controlled clinical trial that establishes safety, efficacy, or bioavailability or bioequivalence of an antibody.

Bioequivalent variants of anti-$Na_v1.7$ antibodies of the invention may be constructed by, for example, making various substitutions of residues or sequences or deleting terminal or internal residues or sequences not needed for biological activity. For example, cysteine residues not essential for biological activity can be deleted or replaced with other amino acids to prevent formation of unnecessary or incorrect intramolecular disulfide bridges upon renaturation. In other contexts, bioequivalent antibodies may include anti-$Na_v1.7$ antibody variants comprising amino acid changes which modify the glycosylation characteristics of the antibodies, e.g., mutations which eliminate or remove glycosylation.

Biological Characteristics of the Antibodies

In general, the antibodies of the present invention may function by binding to any one or more of the domains (I, II, III, IV) of $hNa_v1.7$. In certain embodiments, the antibodies of the present invention may bind to an epitope located on at least one of the extracellular (EC) loops found in any of the domains of $hNa_v1.7$. In certain embodiments, the antibodies of the present invention may function by blocking or inhibiting $Na_v1.7$ activity by binding to EC loop 3 of either or both domain I, and/or domain III. Alternatively, or additionally, the antibodies of the invention may bind to the paddle region of $Na_v1.7$ located between about residues 202-232 of SEQ ID NO. 670. In certain embodiments, the antibodies of the present invention may be bi-specific antibodies. The bi-specific antibodies of the invention may bind one epitope in EC loop 3-1 and may also bind one epitope in a region of $hNa_v1.7$ other than EC loop 3-1. In certain embodiments, the bi-specific antibodies of the invention may bind one epitope in EC loop 3-1 and may also bind one epitope in EC loop 3-3, or in the paddle region, or in any other region within domains I, II, III, or IV of $hNa_v1.7$. In certain embodiments, the bi-specific antibodies of the invention may bind to two different regions within the same EC loop.

More specifically, the anti-$Na_v1.7$ antibodies of the invention may exhibit one or more of the following characteristics: (1) ability to bind to a human $Na_v1.7$ or a fragment thereof and to a non-human (e.g., mouse, monkey, rat, rabbit, dog, pig, etc.) $Na_v1.7$ or fragment thereof; (2) ability to bind to a human $Na_v1.7$ or fragment thereof, but not to a non-human (e.g., mouse, monkey, rat, rabbit, dog, pig, etc.) $Na_v1.7$ or fragment thereof; (3) ability to bind to a human $Na_v1.7$ or fragment thereof and to a non-human primate (e.g. monkey) $Na_v1.7$ or fragment thereof, but not to a mouse, rat, rabbit, dog or pig $Na_v1.7$ or $Na_v1.7$ fragment; (4) ability to bind to a human $Na_v1.7$ or fragment thereof and to a non-human primate (e.g. monkey) $Na_v1.7$ or a fragment thereof, and to a mouse Nav1.7 or a fragment thereof, but not to a rat Nav1.7; (5) ability to bind to a human $Na_v1.7$ or fragment thereof and to a non-human primate (e.g. monkey) $Na_v1.7$ or a fragment thereof, and to a rat Nav1.7 or a fragment thereof, but not to a mouse Nav1.7; (6) may or may not bind to, or cross-react with, other voltage-gated sodium channels, or to any other isoform of a sodium channel (e.g. $Na_v1.1$, $Na_v1.2$, $Na_v1.3$, $Na_v1.4$, $Na_v1.5$, $Na_v1.6$, $Na_v1.8$ or $Na_v1.9$); or (7) ability to block ion flux in cells containing $Na_v1.7$, resulting in the blocking of transmembrane depolarization, as shown by any standard technique known to those skilled in the art, for example, use of a patch clamp method.

Certain anti-$Na_v1.7$ antibodies of the present invention are able to inhibit or attenuate $Na_v1.7$ activity in an in vitro assay. The ability of the antibodies of the invention to bind to and inhibit sodium channel activity may be measured using any standard method known to those skilled in the art, including, electrophysiology (e.g. patch clamp assays), binding assays, radioactive flux assays, membrane potential sensitive fluorescent dyes, ion-sensitive dyes, and voltage sensing based on fluorescent resonance energy transfer (FRET). Non-limiting, exemplary in vitro assays for measuring $Na_v1.7$ activity is illustrated in Examples 6 and 7, herein. In these Examples, cells expressing $hNa_v1.7$ are used to assess the ability of the $Na_v1.7$ antibodies to inhibit ion flux using an assay such as the Ion Work Quattro assay, or the Port-a-Patch system for detecting the ability of the anti-$Na_v1.7$ antibodies to inhibit ion flux through the $Na_v1.7$ channel in cells stably transfected with $hNa_v1.7$.

The present invention includes anti-$Na_v1.7$ antibodies and antigen binding fragments thereof which bind to one or more of the following peptides or fragments thereof: Residue numbers 1-728 of SEQ ID NO: 670 (domain I of $Na_v1.7$ alpha subunit); residues 729-1176 of SEQ ID NO: 670 (domain II of $Na_v1.7$ alpha subunit); residues 1177-1494 of SEQ ID NO: 670 (domain 3 of $Na_v1.7$ alpha subunit); residues 1495-1977 of SEQ ID NO: 670 (domain IV of $Na_v1.7$ alpha subunit); SEQ ID NO: 677 or 725 (hNav1.7, EC3-3); SEQ ID NO: 676 or 678 (hNav1.7, EC3-1); SEQ ID NO: 675 or 679 (hNav1.7 paddle region 2-1). Any of the $Na_v1.7$ peptides described herein, or fragments thereof, may be used to generate anti-$Na_v1.7$ antibodies. In addition, other amino acid sequences for consideration for preparation of antibodies include SEQ ID NO: 671, 672, 673 and/or 674, which all contain the Ror1 signal sequence (the first 29 amino acids of each of SEQ ID NO: 671, 672, 673 and 674) combined with the sequences for the EC loops or the paddle region of $hNa_v1.7$, coupled to human Fc for purposes of generating antibodies. The peptides may be modified to include addition or substitution of certain residues for tagging or for purposes of conjugation to carrier molecules, such as, KLH. For example, a cysteine may be added at either the N terminal or C terminal end of a peptide, or a linker sequence may be added to prepare the peptide for conjugation to, for example, KLH for immunization.

The antibodies specific for $Na_v1.7$ may contain no additional labels or moieties, or they may contain an N-terminal or C-terminal label or moiety. In one embodiment, the label or moiety is biotin. In a binding assay, the location of a label (if any) may determine the orientation of the peptide relative to the surface upon which the peptide is bound. For example, if a surface is coated with avidin, a peptide containing an N-terminal biotin will be oriented such that the C-terminal portion of the peptide will be distal to the surface.

In one embodiment, the invention provides a fully human monoclonal antibody or antigen-binding fragment thereof that specifically binds $hNa_v1.7$ and neutralizes $hNa_v1.7$ activity, wherein the antibody or fragment thereof exhibits one or more of the following characteristics: (i) comprises a HCVR having an amino acid sequence selected from the group consisting of SEQ ID NO: 18, 22, 46, 50, 66, 70, 82, 86, 90, 94, 102, 689, 693, and 705: (ii) comprises a LCVR having an amino acid sequence selected from the group consisting of SEQ ID NO: 20, 24, 48, 52, 68, 72, 84, 88, 92, 96, 104, 691, 695, and 707; (iii) comprises any one or more of the heavy or light chain CDR1, CDR2, and CDR3 sequences depicted in Table 2 and combinations thereof; (iv) is specific for blocking $Na_v1.7$ activity without affecting other sodium channel activity; (v) demonstrates binding specificity for any one or more of the extracellular loops of $Na_v1.7$, including, for example, EC3-1, or EC3-3, comprising amino acid residues ranging from about residues 269-338 of SEQ ID NO: 670, or residues 1333-1382 of SEQ ID NO: 670, respectively; (vi) demonstrates binding specificity for the paddle region of $Na_v1.7$, comprising amino acid residues ranging from about residues 202-232 of SEQ ID NO: 670, (vii) binds any one or more of human, monkey, mouse or rat $Na_v1.7$, or (viii) blocks ion flux in cells containing $Na_v1.7$, resulting in the blocking of transmembrane depolarization, as shown by any standard technique known to those skilled in the art, for example, use of a patch clamp method.

Anti-Nav1.7 Antibodies Comprising Fc Variants

According to certain embodiments of the present invention, anti-$Na_v1.7$ antibodies are provided comprising an Fc domain comprising one or more mutations which enhance or diminish antibody binding to the FcRn receptor, e.g., at acidic pH as compared to neutral pH. For example, the present invention includes anti-$Na_v1.7$ antibodies comprising a mutation in the $C_H2$ or a $C_H3$ region of the Fc domain, wherein the mutation(s) increases the affinity of the Fc domain to FcRn in an acidic environment (e.g., in an endosome where pH ranges from about 5.5 to about 6.0). Such mutations may result in an increase in serum half-life of the antibody when administered to an animal. Non-limiting examples of such Fc modifications include, e.g., a modification at position 250 (e.g., E or Q); 250 and 428 (e.g., L or F); 252 (e.g., L/Y/F/W or T), 254 (e.g., S or T), and 256 (e.g., S/R/Q/E/D or T); or a modification at position 428 and/or 433 (e.g., H/L/R/S/P/Q or K) and/or 434 (e.g., A, W, H, F or Y [N434A, N434W, N434H, N434F or N434Y]); or a modification at position 250 and/or 428; or a modification at position 307 or 308 (e.g., 308F, V308F), and 434. In one embodiment, the modification comprises a 428L (e.g., M428L) and 434S (e.g., N434S) modification; a 428L, 259I (e.g., V259I), and 308F (e.g., V308F) modification; a 433K (e.g., H433K) and a 434 (e.g., 434Y) modification; a 252, 254, and 256 (e.g., 252Y, 254T, and 256E) modification; a 250Q and 428L modification (e.g., T250Q and M428L); and a 307 and/or 308 modification (e.g., 308F or 308P). In yet another embodiment, the modification comprises a 265A (e.g., D265A) and/or a 297A (e.g., N297A) modification.

For example, the present invention includes anti-Na$_v$1.7 antibodies comprising an Fc domain comprising one or more pairs or groups of mutations selected from the group consisting of: 250Q and 248L (e.g., T250Q and M248L); 252Y, 254T and 256E (e.g., M252Y, S254T and T256E); 428L and 434S (e.g., M428L and N434S); 257I and 311I (e.g., P257I and Q311I); 257I and 434H (e.g., P257I and N434H); 376V and 434H (e.g., D376V and N434H); 307A, 380A and 434A (e.g., T307A, E380A and N434A); and 433K and 434F (e.g., H433K and N434F). All possible combinations of the foregoing Fc domain mutations, and other mutations within the antibody variable domains disclosed herein, are contemplated within the scope of the present invention.

The present invention also includes anti-$Na_v$1.7 antibodies comprising a chimeric heavy chain constant ($C_H$) region, wherein the chimeric $C_H$ region comprises segments derived from the $C_H$ regions of more than one immunoglobulin isotype. For example, the antibodies of the invention may comprise a chimeric $C_H$ region comprising part or all of a $C_H2$ domain derived from a human IgG1, human IgG2 or human IgG4 molecule, combined with part or all of a $C_H3$ domain derived from a human IgG1, human IgG2 or human IgG4 molecule. According to certain embodiments, the antibodies of the invention comprise a chimeric $C_H$ region having a chimeric hinge region. For example, a chimeric hinge may comprise an "upper hinge" amino acid sequence (amino acid residues from positions 216 to 227 according to EU numbering) derived from a human IgG1, a human IgG2 or a human IgG4 hinge region, combined with a "lower hinge" sequence (amino acid residues from positions 228 to 236 according to EU numbering) derived from a human IgG1, a human IgG2 or a human IgG4 hinge region. According to certain embodiments, the chimeric hinge region comprises amino acid residues derived from a human IgG1 or a human IgG4 upper hinge and amino acid residues derived from a human IgG2 lower hinge. An antibody comprising a chimeric $C_H$ region as described herein may, in certain embodiments, exhibit modified Fc effector functions without adversely affecting the therapeutic or pharmacokinetic properties of the antibody. (See, e.g., U.S. Provisional Appl. No. 61/759,578, filed Feb. 1, 2013, the disclosure of which is hereby incorporated by reference in its entirety).

Epitope Mapping and Related Technologies

To screen for antibodies that bind to a particular epitope, a routine cross-blocking assay such as that described *Antibodies*, Harlow and Lane (Cold Spring Harbor Press, Cold Spring Harb., N.Y.) can be performed. Other methods include alanine scanning mutants, peptide blots (Reineke (2004) Methods Mol Biol 248:443-63) (herein specifically incorporated by reference in its entirety), or peptide cleavage analysis. In addition, methods such as epitope excision, epitope extraction and chemical modification of antigens can be employed (Tomer (2000) Protein Science 9: 487-496) (herein specifically incorporated by reference in its entirety).

The term "epitope" refers to a site on an antigen to which B and/or T cells respond. B-cell epitopes can be formed both from contiguous amino acids or noncontiguous amino acids juxtaposed by tertiary folding of a protein. Epitopes formed from contiguous amino acids are typically retained on exposure to denaturing solvents, whereas epitopes formed by tertiary folding are typically lost on treatment with denaturing solvents. An epitope typically includes at least 3, and more usually, at least 5 or 8-10 amino acids in a unique spatial conformation.

In certain embodiments, the anti-$Na_v$1.7 antibody or antigen-binding fragment of an antibody binds an epitope within at least one of the $Na_v$1.7 domains I, II, III or IV, or a fragment thereof, wherein domain I ranges from about residue number 1 to about residue number 728 of SEQ ID NO: 670; domain II ranges from about residue number 729 to about residue number 1176 of SEQ ID NO: 670; domain III ranges from about residue number 1177 to about residue number 1494 of SEQ ID NO: 670; and domain IV ranges from about residue number 1495 to about residue number 1977 of SEQ ID NO: 670.

In certain embodiments, the anti-$Na_v$1.7 antibody or antigen-binding fragment of an antibody binds an epitope within any one of the extracellular loops, or a fragment thereof, in any of the domains I, II, III or IV of $Na_v$1.7, or in the paddle region, or a fragment thereof, of $Na_v$1.7.

In one embodiment, the antibody binds an epitope within EC loop 3, or a fragment thereof, of domain I of $Na_v$1.7. In one embodiment, the antibody binds an epitope within EC loop 3 of domain I of $Na_v$1.7 from about residue number 269 to about residue number 338 of SEQ ID NO: 670. In one embodiment, the antibody binds an epitope within EC loop 3 of domain I of $Na_v$1.7 from about residue number 272 to about residue number 326 of SEQ ID NO: 670. In one embodiment, the antibody binds an epitope within EC loop 3 of domain I of $Na_v$1.7 from about residue number 272 to about residue number 310 of SEQ ID NO: 670.

In certain embodiments, the anti-$Na_v$1.7 antibody or antigen-binding fragment of an antibody binds an epitope within extracellular (EC) loop 3, or a fragment thereof, of domain III of $Na_v$1.7. In one embodiment, the antibody binds an epitope within EC loop 3 of domain III of $Na_v$1.7 from about residue number 1333 to about residue number 1382 of SEQ ID NO: 670. In one embodiment, the antibody binds an epitope within EC loop 3 of domain III of $Na_v$1.7 from about residue number 1333 to about residue number 1375 of SEQ ID NO: 670.

In certain embodiments, the anti-$Na_v$1.7 antibody or antigen-binding fragment of an antibody binds an epitope within the paddle region of $Na_v$1.7 (from residue number 202-232 of SEQ ID NO: 670).

In certain embodiments, the anti-$Na_v$1.7 antibody or antigen-binding fragment of an antibody binds an epitope within EC loop 3-2 (from about residue number 874 to about residue number 932 of SEQ ID NO: 670).

In certain embodiments, the anti-$Na_v$1.7 antibody or antigen-binding fragment of an antibody binds an epitope within EC loop number 3-4 (from about residue number 1659 to about residue number 1723 of SEQ ID NO: 670).

In certain embodiments, the anti-$Na_v$1.7 antibodies of the invention may bind an epitope within a fragment of the above-noted loop or paddle regions, for example, residue numbers 202-215 of the paddle region of SEQ ID NO: 670; residues 269-310 of loop 3-1 of SEQ ID NO: 670; residues 269-326 of loop 3-1 of SEQ ID NO: 670; residues 272-310 of loop 3-1 of SEQ ID NO: 670; or residues 1333-1375 of loop 3-3 of SEQ ID NO: 670.

In certain embodiments, the antibody or antibody fragment binds an epitope which includes more than one of the enumerated epitopes of $Na_v$1.7 within domain I, II, III, or IV, and/or within two or three different domains (for example, epitopes within the I, II, and III domains, or within the II, III, and IV domains, or within the I, III, and IV domains, or within the I, II and IV domains.

In certain embodiments, the antibody is a bi-specific antibody that binds one epitope within one domain of Na$_v$1.7 and another epitope within a different domain of Na$_v$1.7. In one embodiment, the antibody is a bi-specific antibody that binds one epitope in EC loop 3 of one domain of Na$_v$1.7 and another epitope in EC loop 3 of a different domain of Na$_v$1.7. In one embodiment, the antibody is a bi-specific antibody that binds one epitope in EC loop 3 of domain I of Na$_v$1.7 and another epitope in EC loop 3 of domain III of Na$_v$1.7. In one embodiment, the antibody is a bi-specific antibody that binds one epitope in EC loop 3 of domain I of Na$_v$1.7, wherein the one epitope ranges from about residue 269 to about residue 338 of SEQ ID NO: 670 and a second epitope in EC loop 3 of domain III of Na$_v$1.7, wherein the second epitope ranges from about residue number 1333 to about residue number 1382 of SEQ ID NO: 670. In one embodiment, the antibody is a bi-specific antibody that binds one epitope in EC loop 3 of either domain I (from about residue 269 to about residue 338 of SEQ ID NO: 670) or domain III (from about residue number 1333 to about residue number 1382 of SEQ ID NO: 670) and a second epitope in the paddle region of Na$_v$1.7 (from about residue 202 to about residue 232 of SEQ ID NO: 670).

The present invention includes anti-Na$_v$1.7 antibodies that bind to the same epitope as any of the specific exemplary antibodies described herein (e.g., H1M852N, H1 M875N, H4H391B, H4H391P, H4H434B, H4H434P, H4H439B, H4H439P, H4H468B, H4H468P, H4H471B, H4H471P, H1H1006B, H1H1006P). Likewise, the present invention also includes anti-Na$_v$1.7 antibodies that compete for binding to Na$_v$1.7 or a Na$_v$1.7 fragment with any of the specific exemplary antibodies described herein.

One can easily determine whether an antibody binds to the same epitope as, or competes for binding with, a reference anti-Na$_v$1.7 antibody by using routine methods known in the art. For example, to determine if a test antibody binds to the same epitope as a reference anti-Na$_v$1.7 antibody of the invention, the reference antibody is allowed to bind to a Na$_v$1.7 protein or peptide under saturating conditions. Next, the ability of a test antibody to bind to the Na$_v$1.7 molecule is assessed. If the test antibody is able to bind to Na$_v$1.7 following saturation binding with the reference anti-Na$_v$1.7 antibody, it can be concluded that the test antibody binds to a different epitope than the reference anti-Na$_v$1.7 antibody. On the other hand, if the test antibody is not able to bind to the Na$_v$1.7 molecule following saturation binding with the reference anti-Na$_v$1.7 antibody, then the test antibody may bind to the same epitope as the epitope bound by the reference anti-Na$_v$1.7 antibody of the invention.

To determine if an antibody competes for binding with a reference anti-Na$_v$1.7 antibody, the above-described binding methodology is performed in two orientations: In a first orientation, the reference antibody is allowed to bind to a Na$_v$1.7 molecule under saturating conditions followed by assessment of binding of the test antibody to the Na$_v$1.7 molecule. In a second orientation, the test antibody is allowed to bind to a Na$_v$1.7 molecule under saturating conditions followed by assessment of binding of the reference antibody to the Na$_v$1.7 molecule. If, in both orientations, only the first (saturating) antibody is capable of binding to the Na$_v$1.7 molecule, then it is concluded that the test antibody and the reference antibody compete for binding to Na$_v$1.7. As will be appreciated by a person of ordinary skill in the art, an antibody that competes for binding with a reference antibody may not necessarily bind to the identical epitope as the reference antibody, but may sterically block binding of the reference antibody by binding an overlapping or adjacent epitope.

Two antibodies bind to the same or overlapping epitope if each competitively inhibits (blocks) binding of the other to the antigen. That is, a 1-, 5-, 10-, 20- or 100-fold excess of one antibody inhibits binding of the other by at least 50% but preferably 75%, 90% or even 99% as measured in a competitive binding assay (see, e.g., Junghans et al., Cancer Res. 1990 50:1495-1502). Alternatively, two antibodies have the same epitope if essentially all amino acid mutations in the antigen that reduce or eliminate binding of one antibody reduce or eliminate binding of the other. Two antibodies have overlapping epitopes if some amino acid mutations that reduce or eliminate binding of one antibody reduce or eliminate binding of the other.

Additional routine experimentation (e.g., peptide mutation and binding analyses) can then be carried out to confirm whether the observed lack of binding of the test antibody is in fact due to binding to the same epitope as the reference antibody or if steric blocking (or another phenomenon) is responsible for the lack of observed binding. Experiments of this sort can be performed using ELISA, RIA, surface plasmon resonance, flow cytometry or any other quantitative or qualitative antibody-binding assay available in the art.

Species Selectivity and Species Cross-Reactivity

According to certain embodiments of the invention, the anti-Na$_v$1.7 antibodies bind to human Na$_v$1.7 but not to Na$_v$1.7 from other species. Alternatively, the anti-Na$_v$1.7 antibodies of the invention, in certain embodiments, bind to human Na$_v$1.7 and to Na$_v$1.7 from one or more non-human species. For example, the anti-Na$_v$1.7 antibodies of the invention may bind to human Na$_v$1.7 and may bind or not bind, as the case may be, to one or more of mouse, rat, guinea pig, hamster, gerbil, pig, cat, dog, rabbit, goat, sheep, cow, horse, camel, cynomolgous, marmoset, rhesus or chimpanzee Na$_v$1.7.

Immunoconjugates

The invention encompasses a human anti-Na$_v$1.7 monoclonal antibody conjugated to a therapeutic moiety ("immunoconjugate"), such as an agent that is capable of reducing pain and/or inflammation, a chemotherapeutic drug, or a radioisotope. The type of therapeutic moiety that may be conjugated to the anti-Na$_v$1.7 antibody will take into account the condition to be treated and the desired therapeutic effect to be achieved. For example, for treating acute or chronic pain, an agent such as an NSAID, an opioid, or a Cox-2 inhibitor, or a local anesthetic agent, or a second Na$_v$1.7 inhibitor may be conjugated to the Na$_v$1.7 antibody. Alternatively, if the desired therapeutic effect is to treat the inflammation associated with a painful condition, it may be advantageous to conjugate an anti-inflammatory agent to the anti-Na$_v$1.7 antibody, such as, but not limited to, celecoxib, or a cytokine antagonist, such as an IL-1 or an IL-6 inhibitor. If the condition to be treated is a cancerous condition, it may be beneficial to conjugate a chemotherapeutic drug, or a radioisotope to the Na$_v$1.7 antibody. Examples of suitable agents for forming immunoconjugates are known in the art, see for example, WO 05/103081.

Multi-Specific Antibodies

The antibodies of the present invention may be monospecific, bi-specific, or multi-specific. Multi-specific antibodies may be specific for different epitopes of one target polypeptide or may contain antigen-binding domains specific for more than one target polypeptide. See, e.g., Tutt et al., 1991, J. Immunol. 147:60-69; Kufer et al., 2004, Trends Biotechnol. 22:238-244. The anti-Nav1.7 antibodies of the present invention can be linked to or co-expressed with another functional molecule, e.g., another peptide or protein. For example, an antibody or fragment thereof can be functionally linked (e.g., by chemical coupling, genetic fusion, noncovalent association or otherwise) to one or more other molecular entities, such as another antibody or antibody fragment to produce a bi-specific or a multi-specific antibody with a second binding specificity. For example, the present invention includes bi-specific antibodies wherein one arm of an immunoglobulin is specific for human $Na_v1.7$ or a fragment thereof, and the other arm of the immunoglobulin is specific for a second therapeutic target or is conjugated to a therapeutic moiety. In certain embodiments of the invention, one arm of an immunoglobulin is specific for an epitope on one EC loop of $hNa_v1.7$ or a fragment thereof, and the other arm of the immunoglobulin is specific for an epitope on a second EC loop of $hNa_v1.7$ or in the paddle region of $hNa_v1.7$. In certain embodiments, one arm of an immunoglobulin is specific for one epitope on one EC loop of $hNa_v1.7$ and the other arm is specific for a second epitope on the same EC loop of $hNa_v1.7$.

An exemplary bi-specific antibody format that can be used in the context of the present invention involves the use of a first immunoglobulin (Ig) $C_H3$ domain and a second Ig $C_H3$ domain, wherein the first and second Ig $C_H3$ domains differ from one another by at least one amino acid, and wherein at least one amino acid difference reduces binding of the bi-specific antibody to Protein A as compared to a bi-specific antibody lacking the amino acid difference. In one embodiment, the first Ig $C_H3$ domain binds Protein A and the second Ig $C_H3$ domain contains a mutation that reduces or abolishes Protein A binding such as an H95R modification (by IMGT exon numbering; H435R by EU numbering). The second $C_H3$ may further comprise a Y96F modification (by IMGT; Y436F by EU). Further modifications that may be found within the second $C_H3$ include: D16E, L18M, N44S, K52N, V57M, and V82I (by IMGT; D356E, L358M, N384S, K392N, V397M, and V422I by EU) in the case of IgG1 antibodies; N44S, K52N, and V82I (IMGT; N384S, K392N, and V422I by EU) in the case of IgG2 antibodies; and Q15R, N44S, K52N, V57M, R69K, E79Q, and V82I (by IMGT; Q355R, N384S, K392N, V397M, R409K, E419Q, and V422I by EU) in the case of IgG4 antibodies. Variations on the bi-specific antibody format described above are contemplated within the scope of the present invention.

Therapeutic Administration and Formulations

The invention provides therapeutic compositions comprising the anti-$Na_v1.7$ antibodies or antigen-binding fragments thereof of the present invention. The administration of therapeutic compositions in accordance with the invention will be administered with suitable carriers, excipients, and other agents that are incorporated into formulations to provide improved transfer, delivery, tolerance, and the like. A multitude of appropriate formulations can be found in the formulary known to all pharmaceutical chemists: Remington's Pharmaceutical Sciences, Mack Publishing Company, Easton, Pa. These formulations include, for example, powders, pastes, ointments, jellies, waxes, oils, lipids, lipid (cationic or anionic) containing vesicles (such as LIPOFECTIN™), DNA conjugates, anhydrous absorption pastes, oil-in-water and water-in-oil emulsions, emulsions carbowax (polyethylene glycols of various molecular weights), semi-solid gels, and semi-solid mixtures containing carbowax. See also Powell et al. "Compendium of excipients for parenteral formulations" PDA (1998) J Pharm Sci Technol 52:238-311.

The dose of antibody may vary depending upon the age and the size of a subject to be administered, target disease, conditions, route of administration, and the like. When the antibody of the present invention is used for treating pain associated with $Na_v1.7$ activity in various conditions and diseases, wherein the condition or disease results in acute or chronic pain, inflammatory pain, neuropathic pain, and the like, in an adult patient, it is advantageous to intravenously administer the antibody of the present invention normally at a single dose of about 0.01 to about 20 mg/kg body weight, more preferably about 0.02 to about 7, about 0.03 to about 5, or about 0.05 to about 3 mg/kg body weight. Depending on the severity of the condition, the frequency and the duration of the treatment can be adjusted.

Various delivery systems are known and can be used to administer the pharmaceutical composition of the invention, e.g., encapsulation in liposomes, microparticles, microcapsules, recombinant cells capable of expressing the mutant viruses, receptor mediated endocytosis (see, e.g., Wu et al. (1987) J. Biol. Chem. 262:4429-4432). Methods of introduction include, but are not limited to, intradermal, intramuscular, intraperitoneal, intravenous, subcutaneous, intranasal, epidural, and oral routes. The composition may be administered by any convenient route, for example by infusion or bolus injection, by absorption through epithelial or mucocutaneous linings (e.g., oral mucosa, rectal and intestinal mucosa, etc.) and may be administered together with other biologically active agents. Administration can be systemic or local.

The pharmaceutical composition can be also delivered in a vesicle, in particular a liposome (see, for example, Langer (1990) Science 249:1527-1533).

In certain situations, the pharmaceutical composition can be delivered in a controlled release system. In one embodiment, a pump may be used. In another embodiment, polymeric materials can be used. In yet another embodiment, a controlled release system can be placed in proximity of the composition's target, thus requiring only a fraction of the systemic dose.

The injectable preparations may include dosage forms for intravenous, subcutaneous, intracutaneous and intramuscular injections, drip infusions, etc. These injectable preparations may be prepared by methods publicly known. For example, the injectable preparations may be prepared, e.g., by dissolving, suspending or emulsifying the antibody or its salt described above in a sterile aqueous medium or an oily medium conventionally used for injections. As the aqueous medium for injections, there are, for example, physiological saline, an isotonic solution containing glucose and other auxiliary agents, etc., which may be used in combination with an appropriate solubilizing agent such as an alcohol (e.g., ethanol), a polyalcohol (e.g., propylene glycol, polyethylene glycol), a nonionic surfactant [e.g., polysorbate 80, HCO-50 (polyoxyethylene (50 mol) adduct of hydrogenated castor oil)], etc. As the oily medium, there are employed, e.g., sesame oil, soybean oil, etc., which may be used in combination with a solubilizing agent such as benzyl benzoate, benzyl alcohol, etc. The injection thus prepared is preferably filled in an appropriate ampoule.

A pharmaceutical composition of the present invention can be delivered subcutaneously or intravenously with a standard needle and syringe. In addition, with respect to subcutaneous delivery, a pen delivery device readily has applications in delivering a pharmaceutical composition of the present invention. Such a pen delivery device can be reusable or disposable. A reusable pen delivery device generally utilizes a replaceable cartridge that contains a pharmaceutical composition. Once all of the pharmaceutical composition within the cartridge has been administered and the cartridge is empty, the empty cartridge can readily be discarded and replaced with a new cartridge that contains the pharmaceutical composition. The pen delivery device can then be reused. In a disposable pen delivery device, there is no replaceable cartridge. Rather, the disposable pen delivery device comes prefilled with the pharmaceutical composition held in a reservoir within the device. Once the reservoir is emptied of the pharmaceutical composition, the entire device is discarded.

Numerous reusable pen and autoinjector delivery devices have applications in the subcutaneous delivery of a pharmaceutical composition of the present invention. Examples include, but certainly are not limited to AUTOPEN™ (Owen Mumford, Inc., Woodstock, UK), DISETRONIC™ pen (Disetronic Medical Systems, Burghdorf, Switzerland), HUMALOG MIX 75/25™ pen, HUMALOG™ pen, HUMALIN 70/30™ pen (Eli Lilly and Co., Indianapolis, Ind.), NOVOPEN™ I, II and III (Novo Nordisk, Copenhagen, Denmark), NOVOPEN JUNIOR™ (Novo Nordisk, Copenhagen, Denmark), BD™ pen (Becton Dickinson, Franklin Lakes, N.J.), OPTIPEN™, OPTIPEN PRO™, OPTIPEN STARLET™, and OPTICLIK™ (sanofi-aventis, Frankfurt, Germany), to name only a few. Examples of disposable pen delivery devices having applications in subcutaneous delivery of a pharmaceutical composition of the present invention include, but certainly are not limited to the SOLOSTAR™ pen (sanofi-aventis), the FLEXPEN™ (Novo Nordisk), and the KWIKPEN™ (Eli Lilly), the SURECLICK™ Autoinjector (Amgen, Thousands Oaks, Calif.), the PENLET™ (Haselmeier, Stuttgart, Germany), the EPIPEN (Dey, L. P.) and the HUMIRA™ Pen (Abbott Labs, Abbott Park, Ill.), to name only a few.

Advantageously, the pharmaceutical compositions for oral or parenteral use described above are prepared into dosage forms in a unit dose suited to fit a dose of the active ingredients. Such dosage forms in a unit dose include, for example, tablets, pills, capsules, injections (ampoules), suppositories, etc. The amount of the aforesaid antibody contained is generally about 5 to about 500 mg per dosage form in a unit dose; especially in the form of injection, it is preferred that the aforesaid antibody is contained in about 5 to about 100 mg and in about 10 to about 250 mg for the other dosage forms.

Administration Regimens

According to certain embodiments of the present invention, multiple doses of an antibody to hNa$_v$1.7 may be administered to a subject over a defined time course. The methods according to this aspect of the invention comprise sequentially administering to a subject multiple doses of an antibody to hNa$_v$1.7. As used herein, "sequentially administering" means that each dose of antibody to hNa$_v$1.7 is administered to the subject at a different point in time, e.g., on different days separated by a predetermined interval (e.g., hours, days, weeks or months). The present invention includes methods which comprise sequentially administering to the patient a single initial dose of an antibody to hNa$_v$1.7, followed by one or more secondary doses of the antibody to hNa$_v$1.7 and optionally followed by one or more tertiary doses of the antibody to hNa$_v$1.7.

The terms "initial dose," "secondary doses," and "tertiary doses," refer to the temporal sequence of administration of the antibody to hNa$_v$1.7. Thus, the "initial dose" is the dose which is administered at the beginning of the treatment regimen (also referred to as the "baseline dose"); the "secondary doses" are the doses which are administered after the initial dose; and the "tertiary doses" are the doses which are administered after the secondary doses. The initial, secondary, and tertiary doses may all contain the same amount of antibody to hNa$_v$1.7, but generally may differ from one another in terms of frequency of administration. In certain embodiments, however, the amount of antibody to hNa$_v$1.7 contained in the initial, secondary and/or tertiary doses vary from one another (e.g., adjusted up or down as appropriate) during the course of treatment. In certain embodiments, two or more (e.g., 2, 3, 4, or 5) doses are administered at the beginning of the treatment regimen as "loading doses" followed by subsequent doses that are administered on a less frequent basis (e.g., "maintenance doses").

In one exemplary embodiment of the present invention, each secondary and/or tertiary dose is administered 1 to 26 (e.g., 1, 1½, 2, 2½, 3, 3½, 4, 4½, 5, 5½, 6, 6½, 7, 7½, 8, 8½, 9, 9½, 10, 10½, 11, 11½, 12, 12½, 13, 13½, 14, 14½, 15, 15½, 16, 16½, 17, 17½, 18, 18½, 19, 19½, 20, 20½, 21, 21½, 22, 22½, 23, 23½, 24, 24½, 25, 25½, 26, 26½, or more) weeks after the immediately preceding dose. The phrase "the immediately preceding dose," as used herein, means, in a sequence of multiple administrations, the dose of antibody to hNa$_v$1.7, which is administered to a patient prior to the administration of the very next dose in the sequence with no intervening doses.

The methods according to this aspect of the invention may comprise administering to a patient any number of secondary and/or tertiary doses of an antibody to hNa$_v$1.7. For example, in certain embodiments, only a single secondary dose is administered to the patient. In other embodiments, two or more (e.g., 2, 3, 4, 5, 6, 7, 8, or more) secondary doses are administered to the patient. Likewise, in certain embodiments, only a single tertiary dose is administered to the patient. In other embodiments, two or more (e.g., 2, 3, 4, 5, 6, 7, 8, or more) tertiary doses are administered to the patient.

In embodiments involving multiple secondary doses, each secondary dose may be administered at the same frequency as the other secondary doses. For example, each secondary dose may be administered to the patient 1 to 2 weeks after the immediately preceding dose. Similarly, in embodiments involving multiple tertiary doses, each tertiary dose may be administered at the same frequency as the other tertiary doses. For example, each tertiary dose may be administered to the patient 2 to 4 weeks after the immediately preceding dose. Alternatively, the frequency at which the secondary and/or tertiary doses are administered to a patient can vary over the course of the treatment regimen. The frequency of administration may also be adjusted during the course of treatment by a physician depending on the needs of the individual patient following clinical examination.

Therapeutic Uses of the Antibodies

The antibodies of the invention are useful for the treatment, prevention and/or amelioration of any disease, disorder, or condition associated with Na$_v$1.7 activity, or for amelioration of at least one symptom associated with the disease, disorder, or condition, or for alleviating the pain associated with such disease, disorder, or condition. Exemplary conditions, diseases and/or disorders, and/or the pain associated with such conditions, diseases, or disorders, that can be treated with the anti-Na$_v$1.7 antibodies of the present invention include acute, chronic, neuropathic, or inflammatory pain, arthritis, migraine, cluster headaches, trigeminal neuralgia, herpetic neuralgia, general neuralgias, epilepsy or epileptic conditions, myotonia, arrhythmia, movement disorders, neuroendocrine disorders, ataxia, irritable bowel syndrome, inflammatory bowel syndrome, faecal urgency, incontinence, rectal hypersensitivity, visceral pain, osteoarthritis pain, gout, post-herpetic neuralgia, diabetic neuropathy, radicular pain, sciatica, back pain, head or neck pain, breakthrough pain, post-surgical pain, cancer pain. Other conditions treatable by the therapeutic methods of the invention included hereditary erythromelalgia, rhinitis, prostate cancer, breast cancer, cervical cancer, or bladder disorders. The antibodies of the invention or antigen-binding fragments thereof may also be used to treat the following conditions: non-malignant acute, chronic, or fracture bone pain; rheumatoid arthritis, spinal stenosis; neuropathic low back pain; myofascial pain syndrome; fibromyalgia; temporomandibular joint pain; visceral pain, including, abdominal; pancreatic; chronic headache pain; tension headache, including, cluster headaches; diabetic neuropathy; HIV-associated neuropathy; Charcot-Marie Tooth neuropathy; hereditary sensory neuropathies; peripheral nerve injury; painful neuromas; ectopic proximal and distal discharges; radiculopathy; chemotherapy induced neuropathic pain; radiotherapy-induced neuropathic pain; post-mastectomy pain; central pain; spinal cord injury pain; post-stroke pain; thalamic pain; complex regional pain syndrome; phantom pain; intractable pain; musculoskeletal pain; joint pain; acute gout pain; mechanical low back pain; neck pain; tendonitis; injury/exercise pain; abdominal pain; pyelonephritis; appendicitis; cholecystitis; intestinal obstruction; hernias; etc; chest pain, including, cardiac pain; pelvic pain, renal colic pain, acute obstetric pain, including, labor pain; cesarean section pain; burn and trauma pain; endometriosis; herpes zoster pain; sickle cell anemia; acute pancreatitis; breakthrough pain; orofacial pain including sinusitis pain, dental pain; multiple sclerosis pain; leprosy pain; Behcet's disease pain; adiposis dolorosa; phlebitic pain; Guillain-Barre pain; painful legs and moving toes; Haglund syndrome; Fabry's disease pain; bladder and urogenital disease; hyperactivity bladder; painful bladder syndrome; interstitial cyctitis; or prostatitis. The antibodies of the invention or antigen-binding fragments thereof may also be used to inhibit tumor cell proliferation or metastasis of tumor cells, such as in prostate, breast and cervical cancers.

Combination Therapies

Combination therapies may include an anti-hNa$_v$1.7 antibody of the invention and, for example, another Na$_v$1.7 antagonist (e.g., anti-Na$_v$1.7 antibody or small molecule inhibitor of Na$_v$1.7), a Na$_v$1.8 antagonist (e.g., anti-Na$_v$1.8 antibody or small molecule inhibitor of Na$_v$1.8), a Na$_v$1.9 antagonist (e.g., anti-Na$_v$1.9 antibody or small molecule inhibitor of Na$_v$1.9), a cytokine inhibitor (e.g., an interleukin-1 (IL-1) inhibitor (such as rilonacept ("IL-1 trap"; Regeneron) or anakinra (KINERET®, Amgen), a small molecule IL-1 antagonist, or an anti-IL-1 antibody); an IL-18 inhibitor (such as a small molecule IL-18 antagonist or an anti-IL-18 antibody); an IL-6 or IL-6R inhibitor (such as a small molecule IL-6 antagonist, an anti-IL-6 antibody or an anti-IL-6 receptor antibody); an antiepileptic drug (e.g., gabapentin, pregabalin); a nerve growth factor (NGF) inhibitor (e.g., a small molecule NGF antagonist or an anti-NGF antibody); low dose cochicine; aspirin or another NSAID; steroids (e.g., prednisone, methotrexate, etc.); low dose cyclosporine A; a tumor necrosis factor (TNF) or TNF receptor inhibitor (e.g., a small molecule TNF or TNFR antagonist or an anti-TNF or TNFR antibody); uric acid synthesis inhibitors (e.g., allopurinol); uric acid excretion promoters (e.g., probenecid, sulfinpyrazone, benzbromarone, etc.); other inflammatory inhibitors (e.g., inhibitors of caspase-1, p38, IKK1/2, CTLA-4Ig, etc.); and/or corticosteroids.

Diagnostic Uses of the Antibodies

The anti-Na$_v$1.7 antibodies of the present invention may also be used to detect and/or measure Na$_v$1.7 in a sample, e.g., for diagnostic purposes. For example, an anti-Na$_v$1.7 antibody, or fragment thereof, may be used to diagnose a condition or disease characterized by aberrant expression (e.g., over-expression, under-expression, lack of expression, etc.) of Na$_v$1.7. Exemplary diagnostic assays for Na$_v$1.7 may comprise, e.g., contacting a sample, obtained from a patient, with an anti-Na$_v$1.7 antibody of the invention, wherein the anti-Na$_v$1.7 antibody is labeled with a detectable label or reporter molecule. Alternatively, an unlabeled anti-Na$_v$1.7 antibody can be used in diagnostic applications in combination with a secondary antibody which is itself detectably labeled. The detectable label or reporter molecule can be a radioisotope, such as $^3$H, $^{14}$C, $^{32}$P, $^{35}$S, or $^{125}$I; a fluorescent or chemiluminescent moiety such as fluorescein isothiocyanate, or rhodamine; or an enzyme such as alkaline phosphatase, β-galactosidase, horseradish peroxidase, or luciferase. Specific exemplary assays that can be used to detect or measure Na$_v$1.7 in a sample include enzyme-linked immunosorbent assay (ELISA), radioimmunoassay (RIA), and fluorescence-activated cell sorting (FACS).

Samples that can be used in Na$_v$1.7 diagnostic assays according to the present invention include any tissue or fluid sample obtainable from a patient, which contains detectable quantities of Na$_v$1.7 protein, or fragments thereof, under normal or pathological conditions. Generally, levels of Na$_v$1.7 in a particular sample obtained from a healthy patient (e.g., a patient not afflicted with a disease or condition associated with abnormal Na$_v$1.7 levels or activity) will be measured to initially establish a baseline, or standard, level of Na$_v$1.7. This baseline level of Na$_v$1.7 can then be compared against the levels of Na$_v$1.7 measured in samples obtained from individuals suspected of having a Na$_v$1.7 related disease or condition, or pain associated with such disease or condition.

EXAMPLES

The following examples are put forth so as to provide those of ordinary skill in the art with a complete disclosure and description of how to make and use the methods and compositions of the invention, and are not intended to limit the scope of what the inventors regard as their invention. Efforts have been made to ensure accuracy with respect to numbers used (e.g., amounts, temperature, etc.) but some experimental errors and deviations should be accounted for. Unless indicated otherwise, parts are parts by weight, molecular weight is average molecular weight, temperature is in degrees Centigrade, and pressure is at or near atmospheric.

Example 1. Generation of Human Antibodies to Human Na$_v$1.7

An immunogen comprising any one of the Na$_v$1.7 peptides having amino acid sequences from extracellular loops 3-1, or 3-3, or from the paddle region (loop 2-1) of human Na$_v$1.7 were utilized to generate antibodies to human Na$_v$1.7. These peptides were conjugated to a carrier, for example, KLH, then administered with an adjuvant to stimulate the immune response, to a VELOCIMMUNE® mouse comprising DNA encoding human Immunoglobulin heavy and kappa light chain variable regions. The antibody immune response was monitored by a Na$_v$1.7-specific immunoassay. When a desired immune response was achieved splenocytes were harvested and fused with mouse myeloma cells to preserve their viability and form hybridoma cell lines. The hybridoma cell lines were screened and selected to identify cell lines that produce Na$_v$1.7-specific antibodies. Using this technique several anti-Na$_v$1.7 chimeric antibodies (i.e., antibodies possessing human variable domains and mouse constant domains) were obtained; two exemplary antibodies generated in this manner were designated as H1M852N and H1M875N. Other anti-Na$_v$1.7 antibodies generated using this method may be found in Table 1, and were designated H1M683N, H1M797N, H1M834N, H1M839N, H1M799N, H1M839N, H1M875N, H1M801N, and H1M836N.

Anti-Na$_v$1.7 antibodies were also isolated directly from antigen-positive B cells without fusion to myeloma cells, as described in U.S. 200710280945A1, herein specifically incorporated by reference in its entirety. Using this method, several fully human anti-Na$_v$1.7 antibodies (i.e., antibodies possessing human variable domains and human constant domains) were obtained; exemplary antibodies generated in this manner were designated as follows: H4H391B, H4H391P, H4H439B, H4H439P, H4H468B, H4H468P, H4H471B, H4H471P, H1H1006B, H1H1006P, H4H434B, H4H434P, H4H362B, H4H362P, H4H441B, H4H441P, H1H1003B, H4H1003P, H1H1025B, and H4H1025P. Other anti-Na$_v$1.7 antibodies generated using this method may also be found in Table 1. Table 2 summarizes the location of the amino acid residues for the heavy and light chain complementarity determining regions (CDRs) for exemplary anti-Na$_v$1.7 antibodies.

The biological properties of the exemplary anti-Na$_v$1.7 antibodies generated in accordance with the methods of this Example are described in detail in the Examples set forth below.

TABLE 1

| Antibody ID | Loop Specificity | V$_H$ DNA SEQ ID NO | V$_H$ Protein SEQ ID NO | V$_L$ DNA SEQ ID NO | V$_L$ Protein SEQ ID NO |
|---|---|---|---|---|---|
| H1M683N | 2-1 | 1 | 2 | 3 | 4 |
| H1M797N | 3-1 | 5 | 6 | 7 | 8 |
| H1M834N | 3-1 | 9 | 10 | 11 | 12 |
| H1M839N | 3-1 | 13 | 14 | 15 | 16 |
| H1M852N | 3-3 | 17 | 18 | 19 | 20 |
| H1M875N | 3-1 | 21 | 22 | 23 | 24 |
| H1M799N | 3-1 | 25 | 26 | 27 | 28 |
| H4H362B | 3-1 | 29 | 30 | 31 | 32 |
| H4H367B | 3-1 | 33 | 34 | 35 | 36 |
| H4H368B | 3-1 | 37 | 38 | 39 | 40 |
| H4H382B | 3-1 | 41 | 42 | 43 | 44 |
| H4H391B | 3-1 | 45 | 46 | 47 | 48 |
| H4H391P | 3-1 | 49 | 50 | 51 | 52 |
| H4H397B | 3-1 | 53 | 54 | 55 | 56 |
| H4H408B | 3-1 | 57 | 58 | 59 | 60 |
| H4H426B | 3-1 | 61 | 62 | 63 | 64 |
| H4H439B | 3-1 | 65 | 66 | 67 | 68 |
| H4H439P | 3-1 | 69 | 70 | 71 | 72 |
| H4H443B | 3-1 | 73 | 74 | 75 | 76 |
| H4H448B | 3-1 | 77 | 78 | 79 | 80 |
| H4H468B | 3-3 | 81 | 82 | 83 | 84 |
| H4H468P | 3-3 | 85 | 86 | 87 | 88 |
| H4H471B | 3-3 | 89 | 90 | 91 | 92 |
| H4H471P | 3-3 | 93 | 94 | 95 | 96 |
| H1H1003B | 3-1 | 97 | 98 | 99 | 100 |
| H1H1006B | 3-1 | 101 | 102 | 103 | 104 |
| H1H1008B | 3-1 | 105 | 106 | 107 | 108 |
| H1H1019B | 3-1 | 109 | 110 | 111 | 112 |
| H1H1010B | 3-1 | 113 | 114 | 115 | 116 |
| H1H1011B | 3-1 | 117 | 118 | 119 | 120 |

TABLE 1-continued

| Antibody ID | Loop Specificity | V$_H$ DNA SEQ ID NO | V$_H$ Protein SEQ ID NO | V$_L$ DNA SEQ ID NO | V$_L$ Protein SEQ ID NO |
|---|---|---|---|---|---|
| H1H1013B | 3-1 | 121 | 122 | 123 | 124 |
| H1H1015B | 3-1 | 125 | 126 | 127 | 128 |
| H1H1022B | 3-1 | 129 | 130 | 131 | 132 |
| H1H1023B | 3-1 | 133 | 134 | 135 | 136 |
| H1H1026B | 3-1 | 137 | 138 | 139 | 140 |
| H1H1030B | 3-1 | 141 | 142 | 143 | 144 |
| H1H1032B | 3-1 | 145 | 146 | 147 | 148 |
| H1H1038B | 3-1 | 149 | 150 | 151 | 152 |
| H1H1041B | 3-1 | 153 | 154 | 155 | 156 |
| H1H1044B | 3-1 | 157 | 158 | 159 | 160 |
| H1H1045B | 3-1 | 161 | 162 | 163 | 164 |
| H1H1050B | 3-1 | 165 | 166 | 167 | 168 |
| H1H1055B | 3-1 | 169 | 170 | 171 | 172 |
| H1H1056B | 3-1 | 173 | 174 | 175 | 176 |
| H1H1059B | 3-1 | 177 | 178 | 179 | 180 |
| H1H1060B | 3-1 | 181 | 182 | 183 | 184 |
| H1H1069B | 3-1 | 185 | 186 | 187 | 188 |
| H1H1082B | 3-1 | 189 | 190 | 191 | 192 |
| H1H1098B | 3-1 | 193 | 194 | 195 | 196 |
| H1H1105B | 3-1 | 197 | 198 | 199 | 200 |
| H1H1123B | 3-1 | 201 | 202 | 203 | 204 |
| H1H1138B | 3-1 | 205 | 206 | 207 | 208 |
| H1H1144B | 3-1 | 209 | 210 | 211 | 212 |
| H1H1147B | 3-1 | 213 | 214 | 215 | 216 |
| H1H1155B | 3-1 | 217 | 218 | 219 | 220 |
| H1H1164B | 3-1 | 221 | 222 | 223 | 224 |
| H1H1166B | 3-1 | 225 | 226 | 227 | 228 |
| H1H1169B | 3-1 | 229 | 230 | 231 | 232 |
| H4H361B | 3-1 | 233 | 234 | 235 | 236 |
| H4H365B | 3-1 | 237 | 238 | 239 | 240 |
| H4H371B | 3-1 | 241 | 242 | 243 | 244 |
| H4H372B | 3-1 | 245 | 246 | 247 | 248 |
| H4H373B | 3-1 | 249 | 250 | 251 | 252 |
| H4H379B | 3-1 | 253 | 254 | 255 | 256 |
| H4H381B | 3-1 | 257 | 258 | 259 | 260 |
| H4H385B | 3-1 | 261 | 262 | 263 | 264 |
| H4H388B | 3-1 | 265 | 266 | 267 | 268 |
| H4H396B | 3-1 | 269 | 270 | 271 | 272 |
| H4H398B | 3-1 | 273 | 274 | 275 | 276 |
| H4H399B | 3-1 | 277 | 278 | 279 | 280 |
| H4H400B | 3-1 | 281 | 282 | 283 | 284 |
| H4H402B | 3-1 | 285 | 286 | 287 | 288 |
| H4H409B | 3-1 | 289 | 290 | 291 | 292 |
| H4H415B | 3-1 | 293 | 294 | 295 | 296 |
| H4H416B | 3-1 | 297 | 298 | 299 | 300 |
| H4H419B | 3-1 | 301 | 302 | 303 | 304 |
| H4H422B | 3-1 | 305 | 306 | 307 | 308 |
| H4H434B | 3-1 | 309 | 310 | 311 | 312 |
| H4H438B | 3-1 | 313 | 314 | 315 | 316 |
| H4H442B | 3-1 | 317 | 318 | 319 | 320 |
| H4H444B | 3-1 | 321 | 322 | 323 | 324 |
| H4H446B | 3-1 | 325 | 326 | 327 | 328 |
| H4H456B | 3-3 | 329 | 330 | 331 | 332 |
| H4H457B | 3-3 | 333 | 334 | 335 | 336 |
| H4H458B | 3-3 | 337 | 338 | 339 | 340 |
| H4H460B | 3-3 | 341 | 342 | 343 | 344 |
| H4H461B | 3-3 | 345 | 346 | 347 | 348 |
| H4H462B | 3-3 | 349 | 350 | 351 | 352 |
| H4H463B | 3-3 | 353 | 354 | 355 | 356 |
| H4H464B | 3-3 | 357 | 358 | 359 | 360 |
| H4H465B | 3-3 | 361 | 362 | 363 | 364 |
| H4H466B | 3-3 | 365 | 366 | 367 | 368 |
| H4H467B | 3-3 | 369 | 370 | 371 | 372 |
| H4H472B | 3-3 | 373 | 374 | 375 | 376 |
| H4H473B | 3-3 | 377 | 378 | 379 | 380 |
| H4H475B | 3-3 | 381 | 382 | 383 | 384 |
| H4H477B | 3-3 | 385 | 386 | 387 | 388 |
| H4H480B | 3-3 | 389 | 390 | 391 | 392 |
| H4H481B | 3-3 | 393 | 394 | 395 | 396 |
| H4H482B | 3-3 | 397 | 398 | 399 | 400 |
| H4H483B | 3-3 | 401 | 402 | 403 | 404 |
| H4H484B | 3-3 | 405 | 406 | 407 | 408 |
| H4H486B | 3-3 | 409 | 410 | 411 | 412 |
| H4H488B | 3-3 | 413 | 414 | 415 | 416 |

TABLE 1-continued

| Antibody ID | Loop Specificity | V_H DNA SEQ ID NO | V_H Protein SEQ ID NO | V_L DNA SEQ ID NO | V_L Protein SEQ ID NO |
|---|---|---|---|---|---|
| H4H489B | 3-3 | 417 | 418 | 419 | 420 |
| H4H491B | 3-3 | 421 | 422 | 423 | 424 |
| H1H1114B | 3-1 | 425 | 426 | — | — |
| H1H1021B | 3-1 | 427 | 428 | — | — |
| H1H1028B | 3-1 | 429 | 430 | — | — |
| H1H1029B | 3-1 | 431 | 432 | — | — |
| H1H1036B | 3-1 | 433 | 434 | — | — |
| H1H1039B | 3-1 | 435 | 436 | — | — |
| H1H1040B | 3-1 | 437 | 438 | — | — |
| H1H1042B | 3-1 | 439 | 440 | — | — |
| H1H1052B | 3-1 | 441 | 442 | — | — |
| H1H1058B | 3-1 | 443 | 444 | — | — |
| H1H1061B | 3-1 | 445 | 446 | — | — |
| H1H1065B | 3-1 | 447 | 448 | — | — |
| H1H1066B | 3-1 | 449 | 450 | — | — |
| H1H1067B | 3-1 | 451 | 452 | — | — |
| H1H1068B | 3-1 | 453 | 454 | — | — |
| H1H1076B | 3-1 | 455 | 456 | — | — |
| H1H1089B | 3-1 | 457 | 458 | — | — |
| H1H1090B | 3-1 | 459 | 460 | — | — |
| H1H1097B | 3-1 | 461 | 462 | — | — |
| H1H1100B | 3-1 | 463 | 464 | — | — |
| H1H1102B | 3-1 | 465 | 466 | — | — |
| H1H1106B | 3-1 | 467 | 468 | — | — |
| H1H1107B | 3-1 | 469 | 470 | — | — |
| H1H1108B | 3-1 | 471 | 472 | — | — |
| H1H1109B | 3-1 | 473 | 474 | — | — |
| H1H1111B | 3-1 | 475 | 476 | — | — |
| H1H1117B | 3-1 | 477 | 478 | — | — |
| H1H1118B | 3-1 | 479 | 480 | — | — |
| H1H1119B | 3-1 | 481 | 482 | — | — |
| H1H1121B | 3-1 | 483 | 484 | — | — |
| H1H1126B | 3-1 | 485 | 486 | — | — |
| H1H1130B | 3-1 | 487 | 488 | — | — |
| H1H1131B | 3-1 | 489 | 490 | — | — |
| H1H1133B | 3-1 | 491 | 492 | — | — |
| H1H1134B | 3-1 | 493 | 494 | — | — |
| H1H1135B | 3-1 | 495 | 496 | — | — |
| H1H1137B | 3-1 | 497 | 498 | — | — |
| H1H1139B | 3-1 | 499 | 500 | — | — |
| H1H1141B | 3-1 | 501 | 502 | — | — |
| H1H1149B | 3-1 | 503 | 504 | — | — |
| H1H1153B | 3-1 | 505 | 506 | — | — |
| H1H1156B | 3-1 | 507 | 508 | — | — |
| H1H1157B | 3-1 | 509 | 510 | — | — |
| H1H1158B | 3-1 | 511 | 512 | — | — |
| H1H1162B | 3-1 | 513 | 514 | — | — |
| H1H1172B | 3-1 | 515 | 516 | — | — |
| H4H370B | 3-1 | 517 | 518 | — | — |
| H4H378B | 3-1 | 519 | 520 | — | — |
| H4H383B | 3-1 | 521 | 522 | — | — |
| H4H389B | 3-1 | 523 | 524 | — | — |
| H4H405B | 3-1 | 525 | 526 | — | — |
| H4H407B | 3-1 | 527 | 528 | — | — |
| H4H413B | 3-1 | 529 | 530 | — | — |
| H4H427B | 3-1 | 531 | 532 | — | — |
| H4H432B | 3-1 | 533 | 534 | — | — |
| H4H436B | 3-1 | 535 | 536 | — | — |
| H4H437B | 3-1 | 537 | 538 | — | — |
| H4H445B | 3-1 | 539 | 540 | — | — |
| H4H453B | 3-1 | 541 | 542 | — | — |
| H4H478B | 3-3 | 543 | 544 | — | — |
| H4H490B | 3-3 | 545 | 546 | — | — |
| H1H1002B | 3-1 | — | — | 547 | 548 |
| H1H1005B | 3-1 | — | — | 549 | 550 |
| H1H1009B | 3-1 | — | — | 551 | 552 |
| H1H1016B | 3-1 | — | — | 553 | 554 |
| H1H1020B | 3-1 | — | — | 555 | 556 |
| H1H1024B | 3-1 | — | — | 557 | 558 |
| H1H1025B | 3-1 | — | — | 559 | 560 |
| H1H1034B | 3-1 | — | — | 561 | 562 |
| H1H1035B | 3-1 | — | — | 563 | 564 |
| H1H1048B | 3-1 | — | — | 565 | 566 |
| H1H1049B | 3-1 | — | — | 567 | 568 |
| H1H1051B | 3-1 | — | — | 569 | 570 |
| H1H1064B | 3-1 | — | — | 571 | 572 |
| H1H1071B | 3-1 | — | — | 573 | 574 |
| H1H1072B | 3-1 | — | — | 575 | 576 |
| H1H1077B | 3-1 | — | — | 577 | 578 |
| H1H1086B | 3-1 | — | — | 579 | 580 |
| H1H1096B | 3-1 | — | — | 581 | 582 |
| H1H1120B | 3-1 | — | — | 583 | 584 |
| H1H1128B | 3-1 | — | — | 585 | 586 |
| H1H1132B | 3-1 | — | — | 587 | 588 |
| H1H1142B | 3-1 | — | — | 589 | 590 |
| H1H1171B | 3-1 | — | — | 591 | 592 |
| H4H363B | 3-1 | — | — | 593 | 594 |
| H4H364B | 3-1 | — | — | 595 | 596 |
| H4H366B | 3-1 | — | — | 597 | 598 |
| H4H369B | 3-1 | — | — | 599 | 600 |
| H4H374B | 3-1 | — | — | 601 | 602 |
| H4H375B | 3-1 | — | — | 603 | 604 |
| H4H376B | 3-1 | — | — | 605 | 606 |
| H4H377B | 3-1 | — | — | 607 | 608 |
| H4H380B | 3-1 | — | — | 609 | 610 |
| H4H384B | 3-1 | — | — | 611 | 612 |
| H4H387B | 3-1 | — | — | 613 | 614 |
| H4H392B | 3-1 | — | — | 615 | 616 |
| H4H394B | 3-1 | — | — | 617 | 618 |
| H4H395B | 3-1 | — | — | 619 | 620 |
| H4H404B | 3-1 | — | — | 621 | 622 |
| H4H410B | 3-1 | — | — | 623 | 624 |
| H4H411B | 3-1 | — | — | 625 | 626 |
| H4H412B | 3-1 | — | — | 627 | 628 |
| H4H414B | 3-1 | — | — | 629 | 630 |
| H4H421B | 3-1 | — | — | 631 | 632 |
| H4H428B | 3-1 | — | — | 633 | 634 |
| H4H430B | 3-1 | — | — | 635 | 636 |
| H4H431B | 3-1 | — | — | 637 | 638 |
| H4H433B | 3-1 | — | — | 639 | 640 |
| H4H435B | 3-1 | — | — | 641 | 642 |
| H4H440B | 3-1 | — | — | 643 | 644 |
| H4H441B | 3-1 | — | — | 645 | 646 |
| H4H450B | 3-1 | — | — | 647 | 648 |
| H4H451B | 3-1 | — | — | 649 | 650 |
| H4H452B | 3-1 | — | — | 651 | 652 |
| H4H455B | 3-1 | — | — | 653 | 654 |
| H4H459B | 3-3 | — | — | 655 | 656 |
| H4H469B | 3-3 | — | — | 657 | 658 |
| H4H470B | 3-3 | — | — | 659 | 660 |
| H4H474B | 3-3 | — | — | 661 | 662 |
| H4H476B | 3-3 | — | — | 663 | 664 |
| H4H479B | 3-3 | — | — | 665 | 666 |
| H4H487B | 3-3 | — | — | 667 | 668 |
| H4H385B | 3-1 | 680 | 681 | 682 | 683 |
| H4H395B | 3-1 | 684 | 685 | 686 | 687 |
| H4H434B | 3-1 | 688 | 689 | 690 | 691 |
| H4H434P | 3-1 | 692 | 693 | 694 | 695 |
| H4H438B | 3-1 | 696 | 697 | 698 | 699 |
| H4H441B | 3-1 | 700 | 701 | 702 | 703 |
| H1H1006P | 3-1 | 704 | 705 | 706 | 707 |
| H1H1068B | 3-1 | 708 | 709 | 710 | 711 |
| H1H1025B | 3-1 | 721 | 722 | 723 | 724 |
| H1M801N | 3-1 | 726 | 727 | 734 | 735 |
| H1M826N | 3-1 | 742 | 743 | 750 | 751 |
| H1M836N | 3-1 | 758 | 759 | 766 | 767 |
| H1M879N | 3-1 | 790 | 791 | 798 | 799 |
| H1M994N | 3-1 | 806 | 807 | 814 | 815 |
| H2M799N | 3-1 | 822 | 823 | 830 | 831 |
| H4H1003P | 3-1 | 859 | 860 | 861 | 862 |
| H4H441P | 3-1 | 863 | 864 | 865 | 866 |
| H4H362P | 3-1 | 867 | 868 | 869 | 870 |
| H4H1025P | 3-1 | 871 | 872 | 873 | 874 |

TABLE 2

| Antibody | SEQ ID NO $V_H$ | Residue No. HCDR1 | HCDR2 | HCDR3 | SEQ ID NO $V_L$ | Residue No. LCDR1 | LCDR2 | LCDR3 |
|---|---|---|---|---|---|---|---|---|
| H1M683N | 2 | 26-33 | 51-58 | 97-110 | 4 | 27-33 | 50-52 | 89-97 |
| H1M797N | 6 | 97-107 | 26-33 | 97-107 | 8 | 27-37 | 55-57 | 94-102 |
| H1M834N | 10 | 26-33 | 51-58 | 97-107 | 12 | 27-37 | 55-57 | 94-102 |
| H1M839N | 14 | 26-33 | 51-58 | 97-107 | 16 | 27-37 | 55-57 | 94-102 |
| H1M852N | 18 | 26-33 | 51-58 | 97-112 | 20 | 27-32 | 50-52 | 89-97 |
| H1M875N | 22 | 26-33 | 51-58 | 97-107 | 24 | 27-37 | 55-57 | 94-102 |
| H1M799N | 26 | 26-33 | 51-58 | 97-113 | 28 | 27-37 | 55-57 | 94-103 |
| H4H362B | 30 | 26-33 | 51-58 | 97-106 | 32 | 27-38 | 56-58 | 95-103 |
| H4H367B | 34 | 26-33 | 51-58 | 97-108 | 36 | 27-32 | 50-52 | 89-97 |
| H4H368B | 38 | 26-33 | 51-58 | 97-108 | 40 | 27-38 | 56-58 | 95-103 |
| H4H382B | 42 | 26-33 | 51-58 | 97-108 | 44 | 27-38 | 56-58 | 95-103 |
| H4H385B | 681 | 26-33 | 51-58 | 97-108 | 683 | 27-38 | 56-58 | 95-103 |
| H4H391B | 46 | 26-33 | 51-58 | 97-108 | 48 | 27-38 | 56-58 | 95-103 |
| H4H391P | 50 | 26-33 | 51-58 | 97-108 | 52 | 27-38 | 56-58 | 95-103 |
| H4H395N | 685 | 26-33 | 51-58 | 97-115 | 687 | 27-38 | 56-58 | 95-103 |
| H4H397B | 54 | 26-33 | 51-58 | 97-108 | 56 | 26-33 | 51-58 | 97-108 |
| H4H408B | 58 | 26-33 | 51-58 | 97-108 | 60 | 27-32 | 50-52 | 89-97 |
| H4H426B | 62 | 26-33 | 51-58 | 97-117 | 64 | 27-32 | 50-52 | 89-97 |
| H4H434B | 689 | 26-33 | 51-58 | 97-111 | 691 | 27-38 | 56-58 | 95-103 |
| H4H434P | 693 | 26-33 | 51-58 | 97-111 | 695 | 27-38 | 56-58 | 95-103 |
| H4H438B | 697 | 26-33 | 51-57 | 96-110 | 699 | 27-32 | 50-52 | 89-97 |
| H4H439B | 66 | 26-33 | 51-57 | 96-110 | 68 | 27-32 | 50-52 | 89-97 |
| H4H439P | 70 | 26-33 | 51-57 | 96-110 | 72 | 27-32 | 50-52 | 89-97 |
| H4H441B | 701 | 26-33 | 51-57 | 96-110 | 703 | 27-32 | 50-52 | 89-97 |
| H4H443B | 74 | 26-33 | 51-58 | 97-117 | 76 | 27-32 | 50-52 | 89-97 |
| H4H448B | 78 | 26-33 | 51-58 | 97-113 | 80 | 27-32 | 50-52 | 89-97 |
| H4H468B | 82 | 26-33 | 51-58 | 97-117 | 84 | 27-32 | 50-52 | 89-97 |
| H4H468P | 86 | 26-33 | 51-58 | 97-117 | 88 | 27-32 | 50-52 | 89-97 |
| H4H471B | 90 | 26-33 | 51-58 | 97-116 | 92 | 27-32 | 50-52 | 89-97 |
| H4H471P | 94 | 26-33 | 51-58 | 97-116 | 96 | 27-32 | 50-52 | 89-97 |
| H1H1003B | 98 | 26-33 | 51-57 | 96-108 | 100 | 27-38 | 56-58 | 95-99 |
| H1H1006B | 102 | 26-35 | 53-59 | 98-110 | 104 | 27-32 | 50-52 | 89-97 |
| H1H1006P | 705 | 26-35 | 53-59 | 98-110 | 707 | 27-32 | 50-52 | 89-97 |
| H1H1008B | 106 | 26-35 | 53-59 | 98-110 | 108 | 27-32 | 50-52 | 89-97 |
| H1H1019B | 110 | 26-35 | 53-59 | 98-110 | 112 | 27-32 | 50-52 | 89-97 |
| H1H1068B | 709 | 26-33 | 51-58 | 97-103 | 711 | 27-38 | 56-58 | 95-103 |
| H1H1025B | 722 | 26-33 | 51-58 | 97-106 | 724 | 27-32 | 50-52 | 89-97 |
| H1M801N | 727 | 26-33 | 51-58 | 97-107 | 735 | 27-37 | 55-57 | 94-102 |
| H1M826N | 743 | 26-33 | 51-58 | 97-107 | 751 | 27-37 | 55-57 | 94-102 |
| H1M836N | 759 | 26-33 | 51-58 | 97-107 | 767 | 27-37 | 55-57 | 94-102 |
| H1M879N | 791 | 26-33 | 51-58 | 97-109 | 799 | 27-32 | 50-52 | 89-97 |
| H1M994N | 807 | 26-33 | 51-58 | 97-107 | 815 | 27-37 | 55-57 | 94-102 |
| H2M799N | 823 | 26-33 | 51-58 | 97-113 | 831 | 27-37 | 55-57 | 94-103 |
| H4H1003P | 860 | 26-33 | 51-57 | 96-108 | 862 | 27-38 | 56-58 | 95-99 |
| H4H441P | 864 | 26-33 | 51-57 | 96-110 | 866 | 27-32 | 50-52 | 89-97 |
| H4H362P | 868 | 26-33 | 51-58 | 97-106 | 870 | 27-38 | 56-58 | 95-103 |
| H4H1025P | 872 | 26-33 | 51-58 | 97-106 | 874 | 27-32 | 50-52 | 89-97 |

Example 2. Variable Gene Utilization Analysis

To analyze the structure of antibodies produced, the nucleic acids encoding antibody variable regions were cloned and sequenced. From the nucleic acid sequence and predicted amino acid sequence of the antibodies, gene usage was identified for each Heavy Chain Variable Region (HCVR) and Light Chain Variable Region (LCVR). Table 3 sets forth the gene usage for selected antibodies in accordance with the invention. NA: Not available.

TABLE 3

| PID | Loop | $V_H$ | D | JH | VK | JK |
|---|---|---|---|---|---|---|
| H1M683N | 2-1 | V3-30 | D6-6 | J6 | V1-9 | J2 |
| H4H362B | 3-1 | V1-18 | D1-7 | J4 | V4-1 | J1 |
| H4H367B | 3-1 | V3-30 | D5-5 | J4 | V1-16 | J4 |
| H4H368B | 3-1 | V3-30 | D5-5 | J4 | V4-1 | J2 |
| H4H382B | 3-1 | V3-30 | D5-5 | J4 | V4-1 | J2 |
| H4H385B | 3-1 | V3-30 | D5-5 | J4 | V4-1 | J2 |
| H4H391B | 3-1 | V3-30 | D5-5 | J4 | V4-1 | J2 |
| H4H395B | 3-1 | V3-23 | D2-2 | J3 | V4-1 | J2 |
| H4H397B | 3-1 | V3-30 | D5-5 | J4 | V4-1 | J2 |
| H4H408B | 3-1 | V3-30 | D5-5 | J4 | V1-17 | J4 |
| H4H426B | 3-1 | V3-9 | D3-9 | J6 | V1-9 | J1 |
| H4H434B | 3-1 | V3-23 | D6-13 | J2 | V4-1 | J2 |
| H4H438B | 3-1 | V4-34 | D1-26 | J2 | V1-39 | J2 |
| H4H439B | 3-1 | V4-34 | D6-6 | J2 | V1-39 | J2 |
| H4H441B | 3-1 | V4-34 | D6-6 | J2 | V1-39 | J2 |
| H4H443B | 3-1 | V3-9 | D3-9 | J6 | V1-9 | J1 |
| H4H448B | 3-1 | V3-9 | D3-9 | J6 | V1-39 | J2 |
| H1M797N | 3-1 | V3-30 | D6-19 | J3 | V2-24 | J3 |
| H2M799N | 3-1 | V3-7 | D3-16 | J6 | V2-28 | J3 |
| H1M834N | 3-1 | V3-30 | D5-12 | J4 | V2-24 | J3 |
| H1M839N | 3-1 | V3-30 | D5-12 | J4 | V2-24 | J3 |
| H1M875N | 3-1 | V3-30 | D5-12 | J4 | V2-24 | J3 |
| H1H1003B | 3-1 | V3-23 | D6-13 | J4 | V4-1 | J3 |
| H1H1006B | 3-1 | V4-39 | D1-1 | J6 | V1-12 | J4 |
| H1H1008B | 3-1 | V4-39 | D1-1 | J6 | V1-12 | J4 |
| H1H1019B | 3-1 | V4-39 | D4-4 | J6 | V1-12 | J4 |
| H1H1025B | 3-1 | NA | NA | NA | V1-17 | J1 |
| H1H1068B | 3-1 | V1-18 | D7-27 | J5 | V4-1 | J1 |
| H4H468B | 3-3 | V3-33 | D6-6 | J6 | V1-6 | J4 |

TABLE 3-continued

| PID | Loop | $V_H$ | D | JH | VK | JK |
|---|---|---|---|---|---|---|
| H4H471B | 3-3 | V3-11 | D4-17 | J6 | V1-16 | J4 |
| H1M852N | 3-3 | V3-33 | D3-22 | J4 | V1-6 | J4 |
| H1M801N | 3-1 | V3-30 | D6-19 | J3 | V2-24 | J3 |
| H1M826N | 3-1 | V3-30 | D5-12 | J4 | V2-24 | J3 |
| H1M836N | 3-1 | V3-30 | D5-12 | J4 | V2-24 | J3 |
| H1M879N | 3-1 | V3-21 | D6-6 | J4 | V3-11 | J1 |
| H1M994N | 3-1 | V3-30 | D6-19 | J3 | V2-24 | J3 |
| H2M799N | 3-1 | V3-7 | D3-16 | J6 | V2-28 | J3 |

Example 3. Binding Affinities of $Na_v1.7$ Antibodies

The binding affinities of anti-$Na_v1.7$ antibodies to $Na_v1.7$ loop peptides were determined by Biacore. For monovalent kinetic experiments, antibodies were captured through the Fc region via a goat anti-Fc-coupled biosensor surface, and the peptides (as analyte) were injected over this captured antibody surface. For bivalent (avidity-driven) kinetic experiments, biotinylated peptides corresponding to the $Na_v1.7$ 3-1, 3-3, or paddle loop sequences were captured on a NeutrAvidin sensor surface, and anti-$Na_v1.7$ antibodies (as analyte) were injected over this surface. Following the capture step, each analyte was individually injected at several concentrations over its respective capture surface, and changes in bound surface units (RU) were monitored. The dissociation rate is independent of the concentration of analyte used in the experiment, and the dissociation rate constant ($k_d$) was determined from the change in antibody-bound analyte RU over time. The Biacore kinetic data were obtained using a double referencing procedure. The double referencing was conducted by first subtracting any interaction of the analyte over the reference surface (i.e., the anti-Fc coupled surface alone or the NeutrAvidin surface alone), thereby correcting for nonspecific binding to capture surface and for refractive index changes. Control buffer injections (no analyte) over the antibody- or peptide-captured surfaces were also performed to allow subtraction of RU signal changes resulting from the natural dissociation of captured binding partner from the sensor surface. The kinetic parameters were obtained by globally fitting the data for all concentrations tested for a given peptide or antibody to a 1:1 binding model using Biacore T100 Evaluation Software version 2.0.2. The $K_D$ was calculated as the dissociation rate constant divided by the association rate constant ($K_D=k_d/k_a$). The dissociative half-life ($t_{1/2}$) was calculated from the dissociation rate constant ($t_{1/2}=\ln 2/k_d$).

Synthetic peptides (Celtek Bioscience, LLC, 1515 Elm Hill Pike, Suite 104, Nashville, Tenn. 37210, USA) representing the extracellular loops of $Na_v1.7$ from various species, including the 3-1, 3-3 loops and the 2-1 (paddle region) sequences of human, monkey, rat and mouse, were generated to characterize the binding profiles of anti-$Na_v1.7$ antibodies to peptides. Both biotinylated and unbiotinylated (native) forms for the various peptides were generated for the Biacore binding experiment set forth below. For biotinylated forms, biotin moieties were covalently attached to the peptide at either the C-terminus or the N-terminus via a $G_4S$ linker. Table 4 sets forth the sequence and derivation of these peptides used for the Biacore binding experiments.

TABLE 4

| Peptide | Species | Sequence Identifier |
|---|---|---|
| Native $Na_v1.7$ (3-1) | human | SEQ ID NO: 854 |
| C-term Biotin $Na_v1.7$ (3-1) | human | SEQ ID NO: 853 |
| N-Term Biotin $Na_v1.7$ (3-1) | mulatta | SEQ ID NO: 718 |
| N-Term Biotin $Na_v1.7$ (3-1) | mouse | SEQ ID NO: 719 |
| Native $Na_v1.7$ (3-1) | rat | SEQ ID NO: 715 |
| Native $Na_v1.7$ (3-3) | human | SEQ ID NO: 677 |
| C-term Biotin $Na_v1.7$ (3-3) | human | SEQ ID NO: 855 |
| C-Term Biotin $Na_v1.7$ (3-3) | mouse | SEQ ID NO: 857 |
| C-Term Biotin $Na_v1.7$ (3-3) | rat | SEQ ID NO: 858 |
| Native $Na_v1.7$ (Paddle) | human | SEQ ID NO: 856 |

Using the monovalent binding format (monovalent peptides injected over captured antibody sensor surface), as shown in Table 5, 27 out of the 30 tested anti-$Na_v1.7$ antibodies bound to human $Na_v1.7$ 3-1 loop peptides with $K_D$ ranging from 0.46 nM to 332 nM. Two antibodies, H4H408B and H1H1025B, did not exhibit measurable binding using this format ("NB" in the table). One antibody, H1H1003B, produced binding data that could not be fit to standard fitting models ("IC" in the table). The tested antibodies showed similar binding behavior to the monkey (mulatta) $Na_v1.7$ 3-1 peptide as for the human peptide, except that H4H426B, H4H443B and H4H448B did not bind to the monkey peptide despite binding to the human peptide when measured in this format (Table 5). Antibodies H1 M797N, H1 M834N, H1 M839N, H1M875N, H1H1003B, H1H1006B, H4H1008B, H1H1019B, H4H367B, H4H368B, H4H397B, H4H434B, and H4H443B, and H1M801N bound to the mouse $Na_v1.7$ 3-1 peptide in this binding format with $K_D$ ranging from 3.5 nM to 2,000 nM (Table 5). Antibodies H4H439P, H1M797N, H1 M834N, H1 M839N, H1 M875N, H1H1006B, H4H1008B, H1H1019B, H4H367B, H4H368B, H4H397B, H4H434B, H4H438B, H4H441B, H4H443B, H1M801N, and H1M836N bound to the rat $Na_v1.7$ 3-1 peptide in this binding format with $K_D$ ranging from 2.6 nM to 750 nM (Table 5). As shown in Table 6, H4H468P and H4H471P as captured antibodies bound to monovalent human $Na_v1.7$ 3-3 loop peptide, but not to mouse or rat peptides under these conditions (H4H471P showed a binding response to the mouse peptide that could not be fit to a 1:1 model; "IC" in the table). As shown in Table 7, captured antibody H1 M683N bound to monovalent human $Na_v1.7$ paddle peptide with a $K_D$ of 9.4 nM.

Using the bivalent (avidity-driven) format, as shown in Table 8, 28 out of 32 tested antibodies demonstrated measurable binding when injected over human $Na_v1.7$ 3-1 loop peptide that was captured on a NeutrAvidin sensor surface through a C-terminal biotin with $K_D$ ranging from 25 pM to 1340 nM. As shown in Table 9, antibodies H4H468P, H4H471P, and H1M852N bound to biotinylated human $Na_v1.7$ 3-3 loop peptide immobilized on a NeutrAvidin sensor surface with $K_D$ ranging from 138 pM to 117 nM.

Tabulated Data Summary:

TABLE 5

Binding constants and dissociative half-lives for Na$_v$1.7 3-1 peptides binding to immobilized antibodies

| mAb | Human Na$_v$1.7 3-1 native K$_D$ (M) | t$_{1/2}$ (min) | Mulatta Na$_v$1.7 3-1 N-term biotin K$_D$ (M) | t$_{1/2}$ (min) | Mouse Na$_v$1.7 3-1 N-term biotin K$_D$ (M) | t$_{1/2}$ (min) | Rat Na$_v$1.7 3-1 native K$_D$ (M) | t$_{1/2}$ (min) |
|---|---|---|---|---|---|---|---|---|
| H4H362B | 6.12E−10 | 8.6 | 2.57E−10 | 36.1 | NB | NB | NB | NB |
| H4H391P | 1.36E−08 | 8.1 | 2.18E−09 | 36.1 | NB | NB | NB | NB |
| H4H439P | 1.53E−08 | 7.7 | 1.39E−09 | 46.8 | NB | NB | 7.50E−07 | 0.083 |
| H1M797N | 4.62E−10 | 16.0 | 4.35E−10 | 43.7 | 7.4E−09 | 4.6 | 2.57E−09 | 5.8 |
| H2M799N | 9.93E−09 | 17.5 | 4.14E−09 | 27.4 | NB | NB | NB | NB |
| H1M834N | 5.53E−09 | 12.0 | 2.39E−09 | 20.3 | 1.92E−08 | 2.8 | 1.02E−08 | 2.3 |
| H1M839N | 3.32E−09 | 18.2 | 1.47E−09 | 28.7 | 1.51E−08 | 3.1 | 7.11E−09 | 3.2 |
| H1M875N | 5.85E−09 | 12.5 | 1.89E−09 | 26.5 | 1.20E−08 | 3.2 | 6.7E−09 | 3.0 |
| H1H1003B | IC | IC | IC | IC | 1.95E−06 | 0.46 | IC | IC |
| H1H1006B | 1.64E−08 | 3.3 | 6.1E−09 | 7.5 | 1.03E−07 | 0.62 | 3.39E−08 | 0.74 |
| H4H1008B | 4.31E−09 | 4.0 | 1.11E−09 | 17.5 | 1.48E−08 | 1.3 | 4.67E−09 | 3.1 |
| H1H1019B | 1.13E−07 | 0.44 | 1.26E−08 | 2.8 | 3.51E−07 | 0.083 | 1.01E−07 | 0.11 |
| H4H367B | 4.67E−09 | 10.5 | 6.3E−10 | 23.7 | 1.07E−07 | 0.59 | 8.80E−08 | 0.42 |
| H4H368B | 6.10E−08 | 3.6 | 1.00E−08 | 10.9 | 1.20E−08 | 964.1 | 1.27E−07 | 0.32 |
| H4H382B | 3.89E−08 | 3.3 | 1.31E−08 | 6.0 | NB | NB | NB | NB |
| H4H385B | 1.88E−07 | 0.80 | 2.93E−08 | 3.1 | NB | NB | NB | NB |
| H4H395B | 1.32E−08 | 20.7 | 2.5E−09 | 34.0 | IC | IC | NB | NB |
| H4H397B | 2.37E−09 | 34.0 | 9.7E−11 | 288.8 | 4.35E−08 | 3.92 | 1.42E−08 | 3.3 |
| H4H408B | NB | NB | NB | NB | NB | NB | NB | NB |
| H4H426B | 6.01E−09 | 6.3 | NB | NB | NB | NB | NB | NB |
| H4H434B | 2.14E−08 | 2.5 | 3.68E−09 | 4.7 | 8.98E−09 | 3.4 | 1.07E−07 | 0.17 |
| H4H438B | 2.73E−09 | 30.2 | 5.4E−10 | 110.6 | NB | NB | 7.70E−08 | 0.56 |
| H4H441B | 6.58E−09 | 12.5 | 4.39E−10 | 128.3 | NB | NB | 1.78E−07 | 0.39 |
| H4H443B | 2.11E−08 | 2.5 | NB | NB | 4.10E−07 | 0.39 | 1.76E−07 | 0.48 |
| H4H448B | 2.19E−08 | 1.8 | NB | NB | IC | IC | IC | IC |
| H1H1025B | NB | NB | NB | NB | NB | NB | NB | NB |
| H1H1068B | 2.36E−07 | 0.16 | 4.26E−08 | 0.34 | IC | IC | IC | IC |
| H1M801N | 3.73E−09 | 4.3 | 8.89E−10 | 16.8 | 3.53E−09 | 4.2 | 4.16E−09 | 3.6 |
| H1M836N | 3.32E−07 | 0.30 | 1.81E−08 | 1.7 | NB | NB | 2.98E−07 | 0.10 |
| H1M879N | 4.43E−09 | 3.0 | 1.05E−09 | 11.7 | NB | NB | NB | NB |

TABLE 6

Binding constants and dissociative half-lives for Na$_v$1.7 3-3 peptides binding to immobilized antibodies

| mAb | Human Na$_v$1.7 3-3 native K$_D$ (M) | t$_{1/2}$ (min) | Mouse Na$_v$1.7 3-3 C-term biotin K$_D$ (M) | t$_{1/2}$ (min) | Rat Na$_v$1.7 3-3 C-term biotin K$_D$ (M) | t$_{1/2}$ (min) |
|---|---|---|---|---|---|---|
| H4H468P | 6.30E−07 | 0.31 | NB | NB | NB | NB |
| H4H471P | 1.60E−08 | 16.99 | IC | IC | NB | NB |
| H1M852N | NB | NB | NB | NB | NB | NB |

TABLE 7

Binding constants and dissociative half-lives for Na$_v$1.7 paddle peptide binding to immobilized antibodies

| mAb | Human Na$_v$1.7 paddle native K$_D$ (M) | t$_{1/2}$ (min) |
|---|---|---|
| H1M683N | 9.40E−09 | 18 |

TABLE 8

Binding constants and dissociative half-lives for antibodies binding to biotinylated human Na$_v$1.7 3-1 peptide captured on NeutrAvidin surface

| mAb | Human Na$_v$1.7 3-1 C-term biotin K$_D$ (M) | t$_{1/2}$ (min) |
|---|---|---|
| H4H362B | 2.18E−10 | 100.7 |
| H4H391P | 8.02E−10 | 64.6 |
| H4H439P | 1.40E−09 | 62.0 |
| H4H468P | NB | NB |
| H4H471P | NB | NB |
| H1M683N | NB | NB |
| H1M797N | 3.59E−10 | 99.1 |
| H2M799N | 8.15E−10 | 106.1 |
| H1M834N | 7.51E−10 | 82.5 |
| H1M839N | 6.92E−10 | 137.4 |
| H1M852N | NB | NB |
| H1M875N | 7.80E−10 | 87.2 |
| H1H1003B | 2.64E−09 | 27.8 |
| H1H1006B | 2.39E−10 | 81.7 |
| H4H1008B | 1.23E−10 | 84.2 |
| H1H1019B | 2.31E−10 | 29.8 |
| H4H367B | 3.41E−10 | 94.0 |
| H4H382B | 1.04E−09 | 92.9 |
| H4H385B | 4.43E−10 | 73.2 |
| H4H395B | 2.52E−11 | 108.1 |
| H4H397B | 2.99E−10 | 206.5 |
| H4H408B | 1.31E−08 | 29.4 |
| H4H426B | 3.80E−10 | 114.9 |
| H4H434B | 3.34E−10 | 113.9 |
| H4H438B | 6.14E−10 | 117.7 |
| H4H441B | 7.03E−10 | 86.9 |

TABLE 8-continued

Binding constants and dissociative half-lives for antibodies binding to biotinylated human Na$_v$1.7 3-1 peptide captured on NeutrAvidin surface

| mAb | Human Na$_v$1.7 3-1 C-term biotin | |
|---|---|---|
| | K$_D$ (M) | t$_{1/2}$ (min) |
| H4H443B | 6.12E−10 | 76.5 |
| H1H1025B | 1.34E−06 | 1.0 |
| H1H1068B | 2.00E−07 | 0.3 |
| H1M801N | 5.11E−10 | 71.0 |
| H1M836N | 1.92E−08 | 3.8 |
| H1M879N | 2.70E−10 | 87.0 |

TABLE 9

Binding constants and dissociative half-lives for antibodies binding to biotinylated human Na$_v$1.7 3-3 peptide captured on NeutrAvidin surface

| mAb | Human Na$_v$1.7 3-3 C-term biotin | |
|---|---|---|
| | K$_D$ (M) | t$_{1/2}$ (min) |
| H4H468P | 4.72E−08 | 1.3 |
| H4H471P | 1.38E−10 | 743.2 |
| H1M852N | 1.17E−07 | 1.3 |

Example 4. Antibody Binding to Na$_v$1.7 Peptides/Species Specificity

Synthetic peptides (Celtek Bioscience, LLC, 1515 Elm Hill Pike, Suite 104, Nashville, Tenn. 37210, USA) representing the extracellular loops of Na$_v$1.7 from various species, including the 3-1, 3-3 loops and the 2-1 (paddle region) sequences of human, monkey, rat and mouse, were generated to characterize the binding profiles of anti-Na$_v$1.7 antibodies by enzyme-linked immunosorbent assay (ELISA). Both biotinylated and unbiotinylated forms for the various peptides were generated for the examples set forth below. For biotinylated forms, biotin moieties were covalently attached to the peptide at either the C-terminus or the N-terminus via a G$_4$S linker. Table 10 sets forth the sequence and derivation of these peptides.

TABLE 10

| Peptide | Species | Sequence Identifier |
|---|---|---|
| Native Na$_v$1.7 (3-3) | human | SEQ ID NO: 677 |
| N-Term Biotin-Na$_v$1.7 (3-1) | human | SEQ ID NO: 712 |
| N-Term Biotin-Na$_v$1.7 (3-3) | human (same sequence of EC3-3 for mulatta) | SEQ ID NO: 713 |
| N-term Biotin Na$_v$1.7 (Paddle) | human | SEQ ID NO: 714 |
| Native Na$_v$1.7 (3-1) | rat | SEQ ID NO: 715 |
| Native Na$_v$1.7 (3-3) | rat | SEQ ID NO: 716 |
| N-Term Biotin Na$_v$1.7 (Paddle) | mulatta | SEQ ID NO: 717 |
| N-Term Biotin Na$_v$1.7 (3-1) | mulatta | SEQ ID NO: 718 |
| N-Term Biotin Na$_v$1.7 (3-1) | mouse | SEQ ID NO: 719 |
| N-term Biotin Na$_v$1.7 (3-3) | mouse | SEQ ID NO: 720 |

Anti-Na$_v$1.7 antibodies were tested for their ability to bind to the Na$_v$1.7 peptides. The various peptides were coated overnight onto 96-well Nunc Immunosorp plates at a concentration of 4 μg/mL in PBS, followed by blocking for 1 hour in a suitable blocking agent. For biotinylated peptides, avidin was first coated on Nunc Immunosorp plates at 2 μg/mL in PBS overnight, followed by blocking as described, and the plate was then coated with biotinylated peptides at a concentration of 0.4 μg/mL and incubated for 1 hour at room temperature. Purified anti-Na$_v$1.7 antibodies were diluted to a final concentration of 0.1 μg/mL and 1.0 μg/mL and added to the wells of the coated microtiter plates followed by incubation for 1 hour at room temperature. Bound antibodies were detected with horseradish peroxidase (HRP) conjugated anti-mouse or anti-human IgG (Jackson Immuno Research Lab, West Grove, Pa.) depending on the antibody species and developed by colorimetric response using tetramethylbenzidine (TMB) substrate (BD Biosciences). Absorbance was read at OD$_{450}$ on a plate reader for 0.1 second.

Values in Table 11 represent absolute binding ranges (at OD450) to plate-coated peptides for antibodies added at 1 μg/ml as follows: OD450<0.2: −; 0.2<OD450<1: +; 1<OD450<2: ++; 2<OD450<4: +++; NT: Not Tested.

As shown in Table 11, anti-Na$_v$1.7 antibodies exhibited different cross-species specificities as determined by ELISA.

TABLE 11

| mAb ID | Loop | Human | Monkey | Mouse | Rat |
|---|---|---|---|---|---|
| H1M683N | 2-1 | ++ | + | NT | NT |
| H4H362B | 3-1 | +++ | +++ | − | +++ |
| H4H367B | 3-1 | +++ | +++ | +++ | +++ |
| H4H368B | 3-1 | +++ | − | +/− | +++ |
| H4H382B | 3-1 | +++ | +++ | + | +++ |
| H4H391B | 3-1 | +++ | +++ | +/− | + |
| H4H397B | 3-1 | +++ | +++ | +++ | +++ |
| H4H408B | 3-1 | +++ | +++ | − | + |
| H4H426B | 3-1 | +++ | ++ | + | ++ |
| H4H439B | 3-1 | +++ | +++ | +/− | ++ |
| H4H443B | 3-1 | +++ | + | + | ++ |
| H4H448B | 3-1 | +++ | − | − | − |
| H1M797N | 3-1 | +++ | +++ | +++ | +++ |
| H2M799N | 3-1 | +++ | +++ | − | − |
| H1M834N | 3-1 | +++ | +++ | ++ | +++ |
| H1M839N | 3-1 | +++ | +++ | +++ | +++ |
| H1M875N | 3-1 | +++ | +++ | +++ | +++ |
| H1H1003B | 3-1 | +++ | +++ | + | +++ |
| H1H1006B | 3-1 | +++ | +++ | +++ | +++ |
| H1H1008B | 3-1 | +++ | +++ | +++ | +++ |
| H1H1019B | 3-1 | +++ | +++ | +++ | +++ |
| H1M801N | 3-1 | ++ | +++ | ++ | ++ |
| H1M836N | 3-1 | +++ | +++ | ++ | ++ |
| H1M879N | 3-1 | +++ | +++ | − | − |
| H4H468B | 3-3 | ++ | ++ | − | +++ |
| H4H471B | 3-3 | +++ | +++ | − | − |
| H1M852N | 3-3 | ++ | ++ | NT | +++ |

Example 5. Antibody Binding to Cells Engineered to Express Na$_v$1.7

To further characterize anti-Na$_v$1.7 antibodies, cells of the human embryonic kidney 293 cell line (HEK293) were genetically engineered to overexpress full length human (SEQ ID NO:670) Na$_v$1.7.

The binding of anti-Na$_v$1.7 human antibodies to full-length Na$_v$1.7 expressed in HEK293 cells was determined by flow cytometry (FACS). HEK293 cells were stably-transfected with full-length human Nav1.7 fused at its N-terminus to the green fluorescent protein (GFP) to generate cell line hNa$_v$1.7-GFP-HEK293. Antibody binding to the transfected cells overexpressing Na$_v$1.7 was compared to binding to the parental HEK293 cell line. To perform the binding experiments, adherent cells were collected using 1 mM EDTA in PBS, washed and re-suspended in cold PBS containing 5% FBS. For each binding experiment, the anti-Na$_v$1.7 antibody (at concentrations ranging from 1 nM to 13 nM), was added to 250,000 cells in 500 µL of PBS with 5% FBS. After incubation for 20 minutes on ice, the secondary antibody, recognizing either human-Fc and conjugated to cyanine 5 (Cy5) or recognizing mouse-Fc and conjugated to allophyocyanin (APC), was then added to the cell mixture at a final secondary antibody concentration of 1.7 nM. After incubating for 20 minutes on ice, the cells were resuspended in PBS+5% FBS and then sorted and analyzed on a flow cytometer to determine relative binding by the candidate antibodies. For FACS analysis, gating was applied to examine only healthy live cells in the antibody binding experiments, and percentage stained was recorded. Staining of secondary antibodies alone to Na$_v$1.7-GFP-HEK293 cells gave low background signals (1-2%). Specific binding was measured as the percent binding to Na$_v$1.7-GFP-HEK293 cells minus percent binding to parental HEK293 cells.

As shown in Table 12, anti-Na$_v$1.7 antibodies demonstrated specific binding to HEK293 cells overexpressing Na$_v$1.7 compared to parental cells.

TABLE 12

|  | % Binding Na$_v$1.7 |
|---|---|
| H4H362B | 3.7 |
| H4H391P | 14.3 |
| H4H468P | 71.8 |
| H1M797N | 14.4 |
| H2M799N | 5.7 |
| H1M834N | 4.8 |
| H1M839N | 5.1 |
| H1M852N | 68.6 |
| H1M875N | 5.9 |
| H1H1003B | 1.3 |
| H1H1006B | 8.6 |
| H1H1008B | 12.5 |
| H1H1019B | 28.1 |
| H4H367B | 15.8 |
| H4H368B | 17.4 |
| H4H443B | 10.1 |
| H4H448B | 9.2 |
| H4H426B | 19.8 |
| H4H382B | 13 |
| H1M801N | 49.5 |
| H1M836N | 68.9 |
| H1M879N | 63 |
| H1M994N | 36 |
| H1M826N | 61 |

In a similar experiment, anti-Na$_v$1.7 antibodies were tested for binding to a human embryonic kidney 293 cell line (HEK293) that was genetically engineered to overexpress full length human (SEQ ID NO: 670) Na$_v$1.7 using an immunostaining procedure. As noted above, HEK293 cells were stably-transfected with full-length human Na$_v$1.7 fused at its N-terminus to the green fluorescent protein (GFP) to generate the cell line hNa$_v$1.7-GFP-HEK293. Antibody binding to the transfected cells overexpressing Na$_v$1.7 was compared to binding to the parental HEK293 cell line. Cross-reactivity of anti-Na$_v$1.7 antibodies was tested using HEK293 cells that express the full length human Na$_v$1.5 after overnight induction with 1 µg/ml doxycycline. Antibody binding to the transfected cells overexpressing Na$_v$1.5 was compared to binding to the same HEK293 cell line without induction. Briefly, cells were plated onto PDL coated 8 chambers culture slides at a density of 150,000 cells/well overnight at 37° C. The following day, media was removed and the cells were washed 3× with PBS. The cells were fixed with 4% PFA at RT for 20 minutes, then permeabilized with 0.05% Triton X-100 for 5 minutes at RT. The cells were blocked with superblock at RT for 1 hour, then incubated with 1 µg of anti Nav1.7 antibodies at 4 degrees overnight. The cells were then incubated in a 1:400 dilution of anti-human Alexa Fluor® 594 (Invitrogen) conjugated secondary antibody for 1 hr at RT and then imaged under a fluorescent microscope using a green filter.

As shown below in Table 13, most of the anti-Na$_v$1.7 antibodies demonstrated positive binding to HEK293 cells expressing full length human Na$_v$1.7, but showed no binding to HEK293 cells expressing full length human Na$_v$1.5 after induction with doxycycline. Any differences observed between the results observed with the immunostaining procedure compared to the results observed in the FACS binding studies above may possibly be explained by differences in reagents utilized, e.g. use of detergents, buffers, etc.

TABLE 13

| PID | Loop Specificity | Immunostaining Na$_v$1.7 | Immunostaining Na$_v$1.5 |
|---|---|---|---|
| H1M683N | 2-1 | − | ND |
| H4H362B | 3-1 | + | High bg |
| H4H367B | 3-1 | + | bg |
| H4H368B | 3-1 | + | bg |
| H4H382B | 3-1 | − | — |
| H4H385B | 3-1 | + | — |
| H4H391B | 3-1 | + | — |
| H4H395B | 3-1 | + | — |
| H4H397B | 3-1 | + | ND |
| H4H434B | 3-1 | +/− | — |
| H4H408B | 3-1 | + | bg |
| H4H426B | 3-1 | − | — |
| H4H438B | 3-1 | + | bg |
| H4H439B | 3-1 | + | — |
| H4H441B | 3-1 | − | ND |
| H4H448B | 3-1 | − | — |
| H1M797N | 3-1 | + | — |
| H4H443B | 3-1 | − | — |
| H2M799N | 3-1 | + | — |
| H1M834N | 3-1 | + | — |
| H1M839N | 3-1 | + | — |
| H1M875N | 3-1 | + | — |
| H1H1003B | 3-1 | + | — |
| H1H1006B | 3-1 | + | High bg |
| H1H1008B | 3-1 | +/− | bg |
| H1H1019B | 3-1 | + | bg |
| H1H1025B | 3-1 | + | bg |
| H1H1068B | 3-1 | +/− | bg |
| H4H468B | 3-3 | − | — |
| H4H471B | 3-3 | +/− | — |
| H4H852N | 3-3 | +/− | — |

TABLE 13-continued

| PID | Loop Specificity | Immunostaining $Na_v1.7$ | $Na_v1.5$ |
|---|---|---|---|
| H1M801 | 3-1 | + | — |
| H1M836 | 3-1 | − | — |
| H1M879 | 3-1 | − | — |

In another experiment, the anti-$Na_v$ 1.7 antibodies were tested for binding to full length h$Na_v$1.7 expressed in the human embryonic kidney 293 cell line (HEK293) that was genetically engineered to overexpress full length human (SEQ ID NO: 670) $Na_v$1.7 (as described above) using a Western Blot procedure.

Cells were harvested using RIPA buffer supplemented with protease inhibitor. Fifteen microliters of cell lysate was combined with 15 μL of SDS sample buffer in a microfuge tube and the mixture was heated at 100° C. for 5 minutes. The samples were separated by SDS-PAGE and transferred to PVDF membrane. The membrane was blocked with 5% (w/v) non-fat dry milk for 1 hr at RT and then incubated with the anti-$Na_v$1.7 antibody at 4° C. overnight. The membrane was washed with TBS-T 3×5 min and then incubated with secondary antibody (1:10,000 dilution) for 1 hr at RT. The secondary antibody was HRP-conjugated anti-human IgG or anti-mouse IgG according to the Fc fragment of the tested anti-$Na_v$1.7 antibody. After washing the membrane 3×15 min it was developed using Thermo Scientific ECL solution and exposed on light-sensitive film.

As shown below in Table 14, the following anti-$Na_v$1.7 antibodies demonstrated binding to PVDF-blotted full-length $Na_v$1.7 from cells: H1 M797N, H2M799N, H1 M834N and H1 M839N.

TABLE 14

| PID | Loop Specificity | WB |
|---|---|---|
| H1M683N | 2-1 | No |
| H1M797N | 3-1 | Yes |
| H2M799N | 3-1 | Yes |
| H1M834N | 3-1 | Yes |
| H1M839N | 3-1 | Yes |
| H1M852N | 3-3 | No |
| H1M875N | 3-1 | No |
| H4H362B | 3-1 | No |
| H4H391B | 3-1 | No |
| H4H439B | 3-1 | No |
| H4H468B | 3-3 | No |
| H4H471B | 3-3 | No |
| H1H1003B | 3-1 | No |
| H1H1006B | 3-1 | No |
| H1H1008B | 3-1 | No |
| H1H1019B | 3-1 | No |
| H1M801N | 3-1 | No |
| H1M836N | 3-1 | No |
| H1M879N | 3-1 | No |

Example 6. Specificity of Anti-$Na_v$1.7 Antibody Binding to Cell-Surface h$Na_v$1.7 as Assessed by Peptide Binding Competition The specificity of binding of anti-$Na_v$1.7 human antibodies to full-length $Na_v$1.7 expressed in HEK293 cells was determined by peptide competition experiments using flow cytometry.

HEK293 cells stably-transfected with full-length $Na_v$1.7 fused at its N-terminus to GFP ($Na_v$1.7-GFP-HEK293) were used for this study. Antibody binding to the transfected cells overexpressing $Na_v$1.7 was compared to binding in the presence of excess peptide and to binding to the parental HEK293 cell line. To perform the binding experiments, adherent cells were collected using 1 mM EDTA in PBS, washed and re-suspended in cold PBS containing 5% FBS. For each binding experiment the anti-$Na_v$1.7 antibody at a final concentration of 3.3 nM (in PBS/5% FBS) was added to cells either directly or after incubating for 10 min on ice with a 1000-fold molar excess (3.3 uM final concentration in PBS/5% FBS) of synthetic peptide with sequence corresponding to the loop specificity of the antibody. The antibodies designated as H4H391P, H4H443B, H4H448B, and H1M797N were preincubated as described above with a synthetic peptide corresponding to EC loop 3-1 (amino acid residues 269-338 of SEQ ID NO: 670), whereas the antibodies designated as H4H468P and H1 M852N were preincubated with a synthetic peptide corresponding to EC loop 3-3 (amino acid residues 1333-1382 of SEQ ID NO: 670). The antibody or antibody-peptide mixture was then allowed to incubate with cells for 20 min on ice, followed by addition of 500 uL of cold PBS/5% FBS. Cells were collected by centrifugation, resuspended in 500 uL of cold PBS/5% FBS, and then secondary antibody matched to the antibody isotype (either anti-human-Fc conjugated to Cyanine 5 or anti-mouse-Fc conjugated to allophyococyanin) was added. Binding was detected on the flow cytometry instrument and analyzed as percent binding using the instrument software. For FACS analysis appropriate gating was applied so that only healthy, live cells were counted. Background staining of secondary antibodies alone to $Na_v$1.7-GFP-HEK293 cells was tested and recorded for all samples, and results ranged between 1-2% binding.

The six anti-$Na_v$1.7 antibodies tested for peptide competition showed a decrease in binding when preincubated with each antibody-specific peptide (Table 15) but did not show the same reduction when incubated with an irrelevant peptide.

TABLE 15

| Ab designation | Loop Specificity | % Binding HEK293 (Parental) | % Binding $Na_v$1.7 (Stable Line) | % Binding $Na_v$1.7 + 1000x Peptide (Competition Binding) |
|---|---|---|---|---|
| H4H391P | EC 3-1 | 3.1 | 7.8 | 2.6 |
| H4H443B | EC 3-1 | 3.0 | 10.1 | 5.1 |
| H4H448B | EC 3-1 | 4.9 | 9.2 | 5.8 |
| H1M797N | EC 3-1 | 20.2 | 45.4 | 10.8 |
| H4H468P | EC 3-3 | 12.5 | 89.5 | 6.1 |
| H1M852N | EC 3-3 | 14.1 | 64.1 | 9.7 |
| H1M801N | EC 3-1 | 15.3 | 49.5 | 1.9 |
| H1M836N | EC 3-1 | 14.9 | 68.9 | 2.2 |
| H1M879N | EC 3-1 | 14.4 | 63 | 1.3 |
| H1M994N | EC 3-1 | 79 | 93 | 33.4 |
| H1M826N | EC 3-1 | 73.6 | 95.6 | 17.7 |

Example 7. Effect of Anti-$Na_v$1.7 Antibodies on Transmembrane Depolarization Determined by IonWorks® Quattro (IWQ) Patch Clamp Device A $Na_v$1.7 stable cell line designated 1810 (Millipore) or a stably-transfected HEK293 cell line expressing full length $Na_v$1.7 receptor, plus a GFP tag at the N-terminus, were used to test the effect of the $Na_v$1.7 antibodies on transmembrane current flux using an IonWorks® Quattro (IWQ, Molecular Devices) patch clamp assay instrument. Human antibodies against $Na_v$1.7 were used from stock solutions at a concentration of 100 μg/ml in the system buffer (10 mM HEPES, 137 mM NaCl, 4 mM KCl, 1.8 mM $CaCl_2$, 10 mM Glucose, 1 mM $MgCl_2$ pH=7.3). A control antibody with a mouse constant region was included as a negative control. A control antibody plus 100 nM of TTX was included as a positive control.

Anti-$Na_v1.7$ antibodies were diluted 3-fold (one part cell suspension, one part system buffer, one part antibody solution) to a final concentration of 223 nM and allowed to incubate for up to 30 min with cells with repetitive pulsing. All antibodies were tested in triplicate on three separate days. The assay was conducted at a holding potential of −80 mV, designed to present the antibody with channels equally divided between inactivated and closed states. The inhibition of the trans-membrane currents was calculated after the first pulse or after the tenth pulse from a holding potential of −80 mV.

As shown in Table 16, multiple test antibodies demonstrated functional inhibition of transmembrane depolarization in multiple experiments.

TABLE 16

| PID | Current blocking (Average % inhibition) |
|---|---|
| H4H362B | 25.5 |
| H4H367B | −35 |
| H4H368B | −16 |
| H4H382B | −6 |
| H4H385B | 31 |
| H4H391B | 48 |
| H4H395B | 57 |
| H4H397B | −50 |
| H4H434B | 17.5 |
| H4H438B | 43.5 |
| H4H439B | 33.6 |
| H4H441B | 81 |
| H1M797N | −31 |
| H2M799N | 6 |
| H1M834N | −14 |
| H1M839N | 13 |
| H1M875N | 25 |
| H1H1003B | 32.5 |
| H1H1006B | 64 |
| H1H1008B | 38 |
| H1H1019B | 24 |
| H1H1025B | 49 |
| H1H1048B | 31 |
| H1H1068B | 34 |
| H4H468B | 45 |
| H4H471B | 57 |
| H4H852N | 7 |

Example 8. Functional Inhibition of $hNa_v1.7$ Channel Depolarization by Anti-$Na_v1.7$ Antibodies Measured by Port-A-Patch® Patch Clamp Device A microchip-based patch-clamp system (Port-a-Patch®, Nanion Technologies, Munich, Germany) was used to determine the ability of anti-$Na_v1.7$ human antibodies to inhibit voltage-gated ion flux through the $Na_v1.7$ ion channel. For these experiments, a HEK293 cell line stably transfected with human $Na_v1.7$ fused at its N-terminus to GFP was used ($hNa_v1.7$-GFP-HEK293). On the day of the recording, cells were harvested by treatment with trypsin (0.025%), centrifuged and resuspended in 500 uL of the extracellular buffer solution (140 mM NaCl, 4 mM KCl, 1 mM $MgCl_2$, 2 mM $CaCl_2$, 5 mM glucose and 10 mM HEPES, adjusted to pH 7.3 with NaOH). Five microliters of the cell suspension was then loaded onto the recording chip. Cells were first perfused with the extracellular buffer solution containing 0.1% (w/v) bovine serum albumin for about 5 minutes to stabilize the patch. The Nav1.7 current was elicited with a repetitive depolarizing step to 0 mV for 20 ms from a holding potential of −100 mV, every 10 s. Cells exhibiting a sodium inward current greater than 1 nA were tested for ion-channel inhibition by addition of test or control antibody solutions at 300, 50 or 30 nM final concentration. The composition of the intracellular recording solution was 140 mM CsF, 10 mM NaCl, 1 mM EGTA and 10 mM HEPES, adjusted to pH 7.3 with CsOH. Tetrodotoxin, a well-validated voltage-gated sodium channel blocker was applied at the end of the experiment as a positive control.

Channel blocking was measured as percent inhibition of observed current flux in the presence of antibody relative to current flux in the absence of antibody, averaged over multiple blocking experiments.

As shown in Table 17, anti-$Na_v1.7$ antibodies were shown to inhibit voltage-dependent depolarization by up to 70% compared to the non-inhibited current level.

TABLE 17

| Antibody | Number of cells tested | Antibody concentration | % Current inhibition (Mean ± SEM) |
|---|---|---|---|
| H4H439B | 10 | 300 nM | 54 ± 10 |
|  | 6 | 50 nM | 69 ± 12 |
|  | 2 | 30 nM | 55 ± 25 |
| H4H391B | 5 | 300 nM | 42 ± 12 |
| H4H468B | 3 | 300 nM | 37 ± 8 |
|  | 5 | 50 nM | 50 ± 3 |
| H4H471B | 6 | 300 nM | 60 ± 10 |
|  | 4 | 50 nM | 55 ± 5 |
|  | 1 | 30 nM | 50 |
| H1M852N | 13 | 50 nM | 40 ± 8 |
| H4H1006B-1 | 4 | 300 nM | 33 ± 3 |
|  | 1 | 50 nM | 20 |
| H4H496B | 12 | 300 nM | 19 ± 6 |
|  | 1 | 50 nM | 0 |

Example 9. Functional Inhibition of $hNa_v1.7$ Channel by Anti-$Na_v1.7$ Antibodies Measured by Q-Patch Clamp Device A $Na_v1.7$ stable cell line designated 1810 (Millipore) or a stably-transfected HEK293 cell line expressing full length $Na_v1.7$ receptor, plus a GFP tag at the N-terminus, were used to test the effect of the $Na_v1.7$ antibodies on human $Na_v1.7$ current using the Q-Patch (Sophion Biosciences) automated patch clamp platform. On the day of the recordings, cells were harvested with accutase cell detachment solution (Millipore, cat # SRC005) and resuspended in 1 mL of a serum free solution [CHO-SFM-II media (Invitrogen, #31033), HEPES 25 mM and penicillin/streptomycin 100 units/mL]. The cell suspension was left on a shaker at RT for 30 minutes before they were loaded on the Q-Patch. $Na_v1.7$ current was elicited by one depolarizing pulse to −30 mV for 20 ms followed by a depolarizing pulse to 0 mV for 20 ms (5 seconds apart) from a holding potential of −100 mV, every 30 seconds. Human anti-$Na_v1.7$ antibodies were diluted to a final concentration of 100 nM in the extracellular buffer (137 mM NaCl, 4 mM KCl, 1.8 mM $CaCl_2$, 1 mM $MgCl_2$, 10 mM Glucose, 10 mM HEPES, pH=7.3) containing 0.2% Bovine Serum Albumin (BSA). TTX (100 nM) was included at the end of the experiment as a positive control.

Cells were first incubated with 0.2% BSA for 16 minutes with repetitive pulsing to allow stabilization of the current and with the anti-$Na_v1.7$ antibodies in the presence of 0.2%

BSA for another 16 minutes with repetitive pulsing. The voltage-dependence of the current was recorded at the end of the incubation with 0.2% BSA and at the end of the incubation with the antibody, currents were elicited with step depolarization from −85 mV to +30 mV in 5 my increment from a holding potential of −100 mV. All antibodies were tested in duplicate on three or more separate days. Channel blocking was measured as percent inhibition of observed current flux in the presence of antibody and 0.2% BSA relative to current flux in the absence of antibody, averaged over multiple blocking experiments.

As shown in Table 18, most antibodies demonstrated functional inhibition of human $Na_v1.7$ current in multiple experiments.

TABLE 18

| Antibody | Number of cells tested | Antibody concentration (nM) | Current inhibition |
|---|---|---|---|
| H4H362B | 13 | 100 | ++ |
| H4H367B | 9 | 100 | + |
| H4H368B | 12 | 100 | + |
| H4H382B | 9 | 100 | + |
| H4H385B | 10 | 100 | — |
| H4H391B | 6 | 100 | − |
| H4H395B | 13 | 100 | + |
| H4H397B | 14 | 100 | — |
| H4H434B | 8 | 100 | — |
| H4H438B | 12 | 100 | + |
| H4H439B | 5 | 100 | + |
| H4H441B | 17 | 100 | ++ |
| H1M797N | 11 | 100 | + |
| H2M799N | 13 | 100 | — |
| H1M834N | 7 | 100 | — |
| H1M839N | 7 | 100 | ++ |
| H1M875N | 12 | 100 | ++ |
| H1H1003B | 9 | 100 | ++ |
| H1H1006B | 7 | 100 | + |
| H1H1008B | 7 | 100 | — |
| H1H1019B | 4 | 100 | + |
| H1H1025B | 14 | 100 | ++ |
| H1H1068B | 11 | 100 | + |
| H4H468B | 13 | 100 | + |
| H4H471B | 15 | 100 | + |
| H4H852N | 4 | 100 | + |
| H1M801 | 15 | 100 | ++ |
| H1M836 | 9 | 100 | ++ |
| H1M879 | 18 | 100 | + |

— No block
+ block<15%
++ block >15% in more than 40% of cells tested

Because most antibodies showed some inhibition, certain criteria were established for determining which antibodies warranted further testing. $Na_v1.7$ antibodies that inhibited human $Na_v1.7$ current more than 15% in 40% of cells tested were selected for further testing in a 4 point dose response assay. Cells were first incubated with 0.2% BSA for 16 minutes with repetitive pulsing to allow stabilization of the current and with anti-$Na_v1.7$ antibody in the presence of 0.2% BSA for 16 minutes at each concentration. The 4 concentrations were tested on the same wells consecutively (with repetitive pulsing). Similarly to the single dose testing of $Na_v1.7$ antibodies, the voltage-dependence of human $Na_v1.7$ current was recorded at the end of the incubation with BSA and at the end of the incubation with each concentration of antibody. TTX (100 nM) was included at the end of the recordings as a positive control. All antibodies were tested in duplicate on three or more separate days. Channel blocking was measured as percent inhibition of observed current flux in the presence of antibody and 0.2% BSA relative to current flux in the absence of antibody, averaged over multiple blocking experiments.

Twelve antibodies were tested, of which 8 showed a dose dependent inhibition of human $Na_v1.7$ current. A negative control antibody (REGN1002) was also included. The results are summarized in Table 19.

TABLE 19

| Antibody | Number of test showing block/ number of test | Number of test showing block | Antibody concentration (nM) | % Current inhibition (Mean ± SEM) |
|---|---|---|---|---|
| H4H362B | 4/6 | 4 | 1 | 6 ± 4 |
| | | | 10 | 24 ± 8 |
| | | | 100 | 53 ± 6 |
| | | | 300 | 65 ± 6 |
| H4H441B | 9/11 | 9 | 1 | 6 ± 3 |
| | | | 10 | 18 ± 6 |
| | | | 100 | 32 ± 7 |
| | | | 300 | 41 ± 6 |
| H1M839N | 4/5 | 4 | 1 | 3 ± 3 |
| | | | 10 | 8 ± 4 |
| | | | 100 | 13 ± 6 |
| | | | 300 | 20 ± 7 |
| H1H1003B | 9/10 | 9 | 1 | 8 ± 3 |
| | | | 10 | 20 ± 6 |
| | | | 100 | 37 ± 8 |
| | | | 300 | 53 ± 8 |
| H4H1025P | 14/27 | 14 | 1 | 11 ± 5 |
| | | | 10 | 22 ± 5 |
| | | | 100 | 40 ± 5 |
| | | | 300 | 54 ± 4 |
| H1M875N | 5/6 | 5 | 1 | 5 ± 2 |
| | | | 10 | 18 ± 6 |
| | | | 100 | 27 ± 12 |
| | | | 300 | 38 ± 10 |
| H1M801N | 7/7 | 7 | 1 | 4 ± 3 |
| | | | 10 | 17 ± 8 |
| | | | 50 | 26 ± 10 |
| | | | 100 | 44 ± 10 |
| H1M836N | 9/10 | 9 | 1 | 9 ± 4 |
| | | | 10 | 29 ± 3 |
| | | | 50 | 39 ± 6 |
| | | | 100 | 52 ± 7 |
| REGN1002 | 4/24 | 4 | 1 | 0 |
| | | | 10 | 3 ± 3 |
| | | | 100 | 9 ± 6 |
| | | | 300 | 28 ± 9 |

These eight antibodies were further tested for cross-reactivity using HEK293 cells that express the full length human $Na_v1.5$ after overnight induction with 1 μg/ml doxycycline. $Na_v1.5$ current was elicited by one depolarizing pulse to 0 mV for 20 ms from a holding potential of −100 mV, every 5 seconds. Cells were first incubated with 0.2% BSA for 16 minutes with repetitive pulsing to allow stabilization of the current and with the anti-$Na_v1.7$ antibodies in presence of 0.2% BSA for another 16 minutes with repetitive pulsing. TTX (2 μM) was included at the end of the recordings as a positive control. Human $Na_v1.7$ antibodies were diluted to a concentration of 100 or 300 nM in the extracellular recording solution (137 mM NaCl, 4 mM KCl, 1.8 mM $CaCl_2$, 1 mM $MgCl_2$, 10 mM glucose, 10 mM HEPES, pH=7.3) containing 0.2% BSA. All antibodies were tested in duplicate on three or more separate days. Channel blocking was measured as percent inhibition of observed current flux in the presence of antibody and 0.2% BSA relative to current flux in the absence of antibody, averaged over multiple blocking experiments. As shown in Table 20, the antibodies did not show significant inhibition of the human $Na_v1.5$ current.

TABLE 20

| Ab PID | Number of Test | Antibody concentration (nM) | Percentage of block of hNav1.5 current (mean ± SEM) |
|---|---|---|---|
| H4H362B | 5 | 300 | 6 ± 4 |
| H1H801N | 8 | 300 | 4 ± 2 |
| H1H875N | 10 | 300 | 4 ± 2 |
| H1H1003B | 7 | 300 | 5 ± 3 |
| H4H1025P | 4 | 300 | 0 ± 0 |

TABLE 20-continued

| Ab PID | Number of Test | Antibody concentration (nM) | Percentage of block of hNav1.5 current (mean ± SEM) |
|---|---|---|---|
| H4H441B | 10 | 300 | 10 ± 4 |
|  | 8 | 100 | 4 ± 2 |
| H1M836N | 15 | 300 | 10 ± 3 |
|  | 12 | 100 | 6 ± 3 |
| H1M839N | 9 | 300 | 7 ± 3 |
|  | 13 | 100 | 6 ± 2 | ments using immunocytochemistry. Synthetic peptides (Celtek Bioscience, LLC, 1515 Elm Hill Pike, Suite 104, Nashville, Tenn. 37210, USA) representing the extracellular loop 3 of domain 1 (EC 3-1) and the extracellular loop 3 of domain 3 (EC 3-3) of $Na_v1.7$ or $Na_v1.5$ alpha subunit from sequence of human was generated to characterize the binding profiles of anti-$Na_v1.7$ antibodies. Antibody binding to DRG was compared to binding in the presence of excess peptide. Binding of $Na_v1.7$ antibodies to DRG neurons was consistent with cross-species binding to peptides determined by Elisa and Biacore. (Table 21A & 21B).

TABLE 21A

| Ab PID | Immunogen | Immuno Scn9a hu/+ MICE | Immuno Scn9a hu3-1/hu3-1 MICE | Immuno Scn9a +/+ MICE | Nav1.7 3-1 native peptide | Nav1.7 3-3 native peptide | Nav1.5 3-1 native peptide | Nav1.5 3-3 native peptide |
|---|---|---|---|---|---|---|---|---|
| H4H391B | 3-1 |  | + | − | + |  | − |  |
| H4H439B | 3-1 | − | − | − |  |  |  |  |
| H1M875N | 3-1 |  |  | + |  |  |  |  |
| H4H468B | 3-3 | + |  | − |  | + |  | − |
| H1H1006B | 3-1 | + | + | + | + |  | − |  |
| H4H852N | 3-3 | +/− |  | − |  |  |  |  |

TABLE 21B

| | | ELISA/Biacore binding to peptides | | | |
|---|---|---|---|---|---|
| Ab PID | Immunogen | Hu | mulatta | Rat | mouse |
| H4H391B | 3-1 | +/+ | +/+ | weak/− | weak/− |
| H4H439B | 3-1 | +/+ | +/+ | +/+ | −/− |
| H1M875N | 3-1 | +/+ | +/+ | +/+ | +/+ |
| H4H468B | 3-3 | +/+ | +/+ | +/>200 nM | −/− |
| H1H1006B | 3-1 | +/+ | +/+ | +/+ | +/+ |
| H4H852N | 3-3 | +/>200 nM | +/+ | +/− | −/− |

Example 10. Antibody Binding to Dorsal Root Ganglion (DRG) Nociceptive Neurons $Na_v1.7$ is preferentially expressed in dorsal root ganglia (DRG) nociceptive neurons. Selected human anti-$Na_v1.7$ antibodies were evaluated for binding to DRG neurons harvested from mice engineered to express human $Na_v1.7$ (Scn9a$^{hu/+}$), mice engineered to express a chimeric $Na_v1.7$ containing a human extracellular pore loop (Scn9a$^{hu3-1/hu3-1}$) and wild type mice (Scn9a$^{+/+}$).

Briefly, lumbar DRGs were harvested from Scn9a$^{hu/+}$, Scn9a$^{hu3-1/hu3-1}$ and Scn9a$^{+/+}$ mice. After dissociation, cells were plated at a density of 5.5×10$^4$ cells/well on 96 well plates treated with poly-DL-ornithine (0.1 mg/ml) and laminin (5 µg/ml) followed by incubation at 37° C. in 96.5% air and 3.5% CO$_2$. Neurons were maintained in culture in DMEM supplemented with 50 ng/ml nerve growth factor, 100 U/ml penicillin/streptomycin, MEM vitamins, and 10% heat-inactivated fetal calf serum.

After 3 to 8 days in culture, neurons were fixed in 4% PFA and 4% sucrose in PBS for 30 minutes, and permeabilized in 10% NGS and 0.1% Triton X-100. Neurons were then incubated overnight at 4° C. with anti-$Na_v1.7$ antibodies at 66 nM (1 µg). The next day, neurons were incubated in 1:400 dilution of anti-human Alexa Fluor® 594 (Invitrogen) conjugated secondary antibody for 1 h at RT. Images were taken using a fluorescent microscope.

The specificity of binding of anti-$Na_v1.7$ human antibodies to DRG was determined by peptide competition experi- Example 11. Calcitonin Gene-Related Peptide (CGRP) Release Assay The neuropeptide calcitonin gene-related peptide (CGRP) is released from peripheral and spinal terminals of peptidergic M and C-fibers nociceptive neurons in response to stimuli. Neuropeptide release initiates neurogenic inflammation, mast cells degranulation and other inflammatory reactions, which result in pain sensation. Inflammatory mediators such as prostaglandin E2, bradykinin, serotonin, histamine and capsaicin directly sensitize and excite nociceptive DRG in vitro and in vivo. Sensitization of DRGs and firing of action potentials can be achieved in vitro with different inflammatory mediators resulting in the release of CGRP and thereby serve as a means to measure DRG nociceptive function.

As a control, two known sodium voltage-gated channel inhibitors (tetrodotoxin (TTX) and lidocaine) were tested to determine whether $Na_v1.7$ plays a role in an inflammatory supernatant induced-release of CGRP in DRG in vitro.

Briefly, DRG between 4 to 8 days in culture were washed once in assay buffer and kept at 37° C. An inflammatory supernatant was prepared in assay buffer (e.g. 10 µM prostaglandin, 10 µM bradykinin and 1 µM capsaicin). Neurons were either incubated for 20 minutes with 10 nM TTX or 5 mM lidocaine followed by stimulation with the inflammatory supernatant or with 10 nM TTX plus inflammatory supernatant or with 5 mM lidocaine plus inflammatory supernatant for 20 minutes. The results showed that when the neurons are pre-incubated with the inhibitors for 20 minutes prior to the stimulation with the inflammatory supernatant, the inflammatory supernatant-induced release of CGRP is significantly enhanced. However, when the neurons are co-incubated with the inhibitors and the inflammatory supernatant for 20 minutes, the inhibitors have no effect on the inflammatory supernatant-induced release of CGRP.

A similar experiment was performed with another toxin, ProTx-II. At 10 nM, ProTx-II largely inhibits $Na_v1.7$. The results showed that pre-incubation with ProTx-II for 20 minutes significantly increased the release of CGRP while addition of ProTx-II to the inflammatory supernatant had no effect on the inflammatory supernatant-induced CGRP release.

The effect of $Na_v1.7$ inhibitors on the inflammatory supernatant-induced CGRP release was also demonstrated in DRG isolated from $Scn9a^{+/+}$, $scn9a^{hu3-1/hu3-1}$ and $Scn9a^{hu/+}$ mice, as set forth below.

In another experiment, selected anti-$Na_v1.7$ human antibodies at a concentration of 300 nM were tested for their effect on in vitro CGRP release in DRG isolated from $Scn9a^{+/+}$. The results showed that pre-incubation with anti-$Na_v1.7$ for 20 minutes before stimulation with inflammatory supernatant significantly enhanced the release of CGRP.

In a similar experiment, selected anti-$Na_v1.7$ human antibodies were tested for their effect on in vitro CGRP release in DRG isolated from $Scn9a^{+/+}$, $scn9a^{hu3-1/hu3-1}$ and $Scn9a^{hu/+}$ mice. Testing human $Na_v1.7$ antibodies that do not cross with mouse such as H4H852N and H4H439B or antibodies that bind to the extracellular loop 3 of domain 1 (EC 3-1) such as H4H439B and H1H1006B or antibodies that bind to the extracellular loop 3 of domain 3 (EC 3-3) showed specific binding to $Na_v1.7$ channels in DRG neurons. As shown in Table 22, the effect of $Na_v1.7$ antibodies on in vitro CGRP release assay correlates with cross-species binding to peptides determined by ELISA and Biacore. These data suggest that the $Na_v1.7$ antibodies that were generated bind specifically to human $Na_v1.7$ channels in DRG neurons and are functional.

Animals

Male Sprague-Dawley rats (Hsd:Sprague-Dawley®™ SD®™, Harlan, Indianapolis, Ind., U.S.A.) were housed 3 per cage, acclimated to the facility prior to study initiation and dosed in a fed state. All testing was done in a blinded manner.

After the pre-treatment baseline assessment, animals were assigned to treatment groups based on baseline response thresholds for the paw pressure endpoint so that group means were approximately equal. Briefly, all animals that met the inclusion criteria above were ranked by response threshold from lowest to highest and treatments were assigned as follows (e.g. A, B, C, D, E, B, C, D, E, A, C, D, E, A, B, D, E, A, B, C, etc). The animals were then dosed in sequence based on treatment time, so that the distribution of treatment across a given set of animals was not predictable.

Anti-$Na_v1.7$ Candidate Antibodies

In this study, the antibodies were prepared individually by dilution with Phosphate Buffered Saline (Sigma Phosphate Buffered Saline 10× Concentrate, diluted 1:9 vol:vol with saline solution 0.9% (Phoenix Pharmaceuticals, Inc.). Briefly, antibodies stored frozen were allowed to reach room temperature, and then adjusted to a concentration of 50 mg/mL from the pre-labeled concentration. All antibodies were administered via intraperitoneal injection in a dose volume of 1 mL/kg based on individual animal body weight.

Mechanical Threshold Testing

Baseline and post-treatment paw withdrawal thresholds to a mechanical stimulus were measured using the Randall-Selitto paw pressure apparatus (Ugo Basile Analgesymeter, model #7200). This apparatus generates a linearly increasing mechanical force. The stimulus is applied to the plantar surface of the hind paw by a dome-shaped plastic tip placed between the $3^{rd}$ and $4^{th}$ metatarsus. To avoid tissue damage, a cutoff pressure is set at 250 g. Mechanical thresholds were defined as the force in grams at the first pain behavior, which includes paw withdrawal, struggle, and/or vocalization. The mean and standard error of the mean (SEM) were determined for the injured paws for each treatment group.

TABLE 22

| Ab PID | Loop specificity | CGRP Scn9a Hu/+ DRG | CGRP Scn9a Hu3-1/Hu3-1 DRG | CGRP Scn9a +/+ DRG | ELISA/Biacore binding to peptides | | |
|---|---|---|---|---|---|---|---|
| | | | | | Hu | rat | mouse |
| H4H439B | 3-1 | + | + | − | +/+ | +/+ | −/− |
| H1M875N | 3-1 | ND | ND | + | +/+ | +/+ | +/+ |
| H1H1006B | 3-1 | + | + | + | +/+ | +/+ | +/+ |
| H4H852N | 3-3 | + | − | − | +/>200 nM | +/− | −/− |

Example 12. Effect of Anti-$Na_v1.7$ Antibodies In Vivo in a Rat Model of Acute Nociception A study was conducted to evaluate the effects of certain of the anti-$Na_v1.7$ antibodies in rats to determine their effect on acute nociception. Anti-$Na_v1.7$ antibodies designated REGN1063 (H4H439P) and REGN1064 (H4H468P), as well as a control isotype matched antibody REGN646 were administered via intraperitoneal injection at a dose of 50 mg/kg. Mechanical and thermal nociceptive threshold (paw pressure, and Hargreaves' test, respectively) testing was conducted before antibody administration and again approximately 24 and 48 hours after injection of the antibodies.

Thermal Threshold Testing

Baseline and post-treatment paw withdrawal latencies to a noxious thermal stimulus were measured using the radiant heat test (Hargreaves, K. et al., 1988, Pain, Vol. 32(1):77-88) using a plantar test apparatus (IITC, Woodland Hills, Calif., model #390). The stimulus intensity was set to 30% of maximum output and the cut-off time was set at 45 seconds. Rats were placed on a glass platform warmed to 28±2° C. and allowed to habituate to the testing chambers for a minimum of 15 minutes prior to each test session. The thermal stimulus was applied to the plantar surface of the paw, and three readings per rat per paw are taken at each test session. Thermal thresholds are defined as the latency in seconds to the first pain behavior, which includes nocifensive paw withdrawal, flinching, biting and/or licking of the stimulated paw. Three readings for each paw per animal were averaged at each individual time point, and the mean and standard error of the mean (SEM) were determined for the left and right paws (pooled values) for each treatment group.

Data Analysis

To determine whether the test articles significantly altered paw withdrawal thresholds or thermal nociceptive responses, an unpaired t-test was run at each time point (1, 2, and 4 hours post-treatment) comparing the control antibody (REGN646), with the given candidate antibodies, REGN1063 (H4H439P) and REGN1064 (H4H468P). Statistical analyses were conducted using Prism™ 5.01 (GraphPad, San Diego, Calif., USA).

Results

Figure 2:
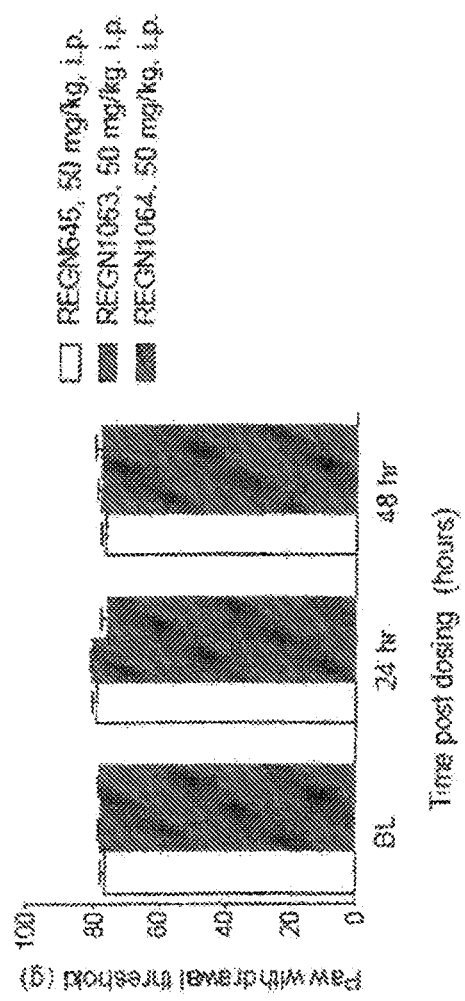
FIG. 2—Demonstrates paw pressure thresholds (pooled left and right hind paw values) to a mechanical stimulus before and after treatment with control antibody REGN646, or with REGN1063 (H4H439P), or REGN1064 (H4H468P).

As shown in FIG. 2, intraperitoneal injection of the candidate antibodies REGN1063 (H4H439P) and REGN1064 (H4H468P) at 50 mg/kg did not result in significant changes in paw withdrawal thresholds to a mechanical stimulus 24 or 48 hours post-injection compared to control antibody (REGN646) treated animals (with significance set at p≤0.05, unpaired t-test). Shown are the mean±SEM (n=8) paw withdrawal thresholds for REGN646, REGN1063 and REGN1064-treated animals at the time points specified.

Figure 3:
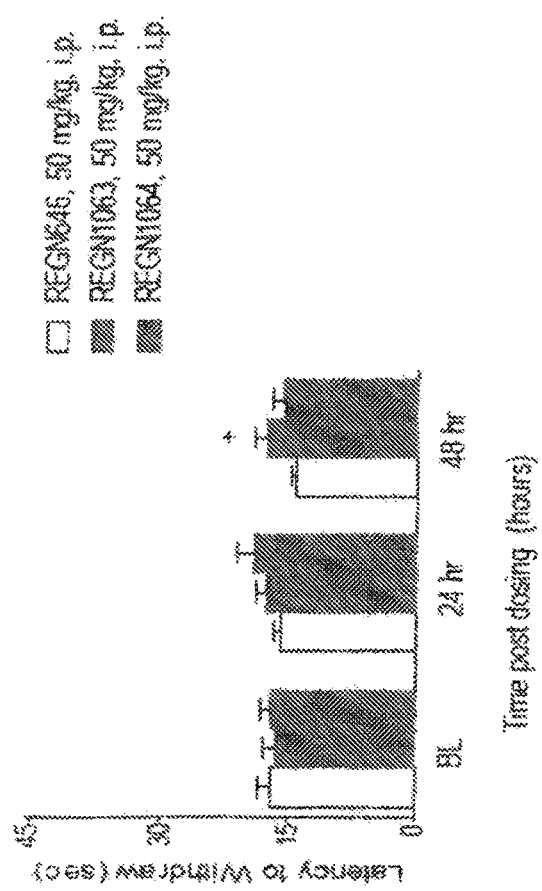
FIG. 3—Demonstrates paw withdrawal latencies (pooled left and right hind paw values) to a noxious thermal stimulus before and after treatment with REGN646 (control), REGN1063 (H4H439P), or REGN1064 (H4H468P).

As shown in FIG. 3 and in Table 23 below, intraperitoneal injection of the candidate antibody REGN1063 (H4H439P) at 50 mg/kg resulted in a significant increase in thermal nociceptive thresholds at 48 hours post-injection compared to REGN646 (+:p≤0.05, unpaired t-test). REGN1064 (H4H468P) at 50 mg/kg, did not significantly change thermal nociceptive thresholds at any time after dosing. Shown are the mean±SEM (n=8) latency to withdraw thresholds for REGN646, REGN1063 and REGN1064-treated animals at the time points specified.

Conclusions

Administration of the candidate anti-$Na_v1.7$ antibodies REGN1063 and REGN1064 (50 mg/kg, i.p.) did not significantly affect the mechanical stimulus threshold at any time point tested following dosing compared to the control antibody, REGN646. However, REGN1063 (50 mg/kg, i.p.) administration significantly increased thermal nociceptive thresholds compared to the control, REGN646, at 48 hours after dosing. The data showing the effect of the REGN1063 and REGN 1064 antibodies on thermal nociceptive thresholds compared to control antibody is summarized in Table 23 below (*p 0.05) and in FIG. 3.

TABLE 23

| | Baseline | | 24 hr | | 48 hr | |
|---|---|---|---|---|---|---|
| | AVG | SEM | AVG | SEM | AVG | SEM |
| NEG CTRL | 17.1 | 1.5 | 15.9 | 0.87 | 14.2 | 0.70 |
| REGN1063 (H4H439P) | 16.5 | 1.5 | 17.6 | 1.2 | 17.7* | 1.5 |
| REGN1064 (H4H468P) | 17 | 1.4 | 19 | 2.1 | 15.7 | 1.2 |

Example 13. Effect of Anti-$Na_v1.7$ Antibodies on Reduction of Pain In Vivo in a Carageenan Pain Model Injection of λ-carrageenan, a polysaccharide obtained from seaweed extract, produces robust inflammation and nociceptive hypersensitivity with a peak effect at 3-5 hours post-injection. Selected anti-h$Na_v1.7$ antibodies are tested for the ability to decrease λ-carrageenan-induced thermal nociceptive hypersensitivity.

C57BL/6 mice are separated into groups of eight mice per antibody tested. All mice receive a dose of about 50 mg/kg of antibody by subcutaneous injection. A control group of C57BL/6 mice receive an irrelevant antibody of the same isotype as the test antibodies. Peripheral inflammation is produced in the mice by a 25 µL subcutaneous (s.c.) injection of a 1%-2% λ-carrageenan solution (dissolved in saline) into the subplantar side of the left hind paw. The hind paw thermal sensitivity of the mice before and at 1 and 3 hours after λ-carrageenan injection is tested using the Hargreaves' apparatus (IITC Life Science, Inc.), which measures the latency of the animals to withdraw their hindpaw from a noxious thermal stimulus. Three separate measurements are performed for each mouse and the mean thermal nociception threshold for each group is calculated (mean±SEM). The mean values for each group are statistically compared to the control group using a one-way analysis of variance (ANOVA). The amount of edema present is also determined by measuring hindpaw thickness with calipers before and at 3 hours after λ-carrageenan injection. Blood is collected at the end of the experiment and the levels of circulating anti-hNav1.7 antibodies (serum Ab) are determined using a standard ELISA assay. Briefly, plates are coated with a goat anti-human Fc antibody (Sigma-Aldrich) to capture serum Ab. Serum is then added to the plates and captured anti-h$Na_v1.7$ antibodies are detected by colorimetric substrate using a horseradish peroxidase (HRP) conjugated goat anti-human IgG antibody (Sigma-Aldrich).

The animals receiving an effective dose of an anti-Nav1.7 antibody sufficient to block or neutralize $Na_v1.7$ activity will demonstrate a significant reduction in thermal sensitivity as compared to animals receiving an irrelevant antibody of the same isotype.

Example 14. Generation of a Bi-Specific Anti-$Na_v1.7$ Antibody $Na_v1.7$-specific channel blockers are generated in a bi-specific format (a "bi-specific") in which loop-specific variable regions are linked together to confer dual-loop specificity within a single binding molecule. Appropriately designed bi-specifics should enhance overall channel blocking efficacy through increasing both $Na_v1.7$ channel specificity and binding avidity. Variable regions with specificity for an individual loop (e.g., EC3-1, EC3-3, or paddle region 2-1 $Na_v1.7$ loop-specific binders) or that can bind to different regions within one loop are paired on a structural scaffold that allows each variable region to bind simultaneously to the separate loops, or to different regions within one loop. In one example for a bi-specific, heavy chain variable regions ($V_H$) from a binder with one loop specificity are recombined with light chain variable regions ($V_L$) from a series of binders with a second loop specificity to identify non-cognate $V_L$ partners that can be paired with an original $V_H$ without disrupting the original specificity for that $V_H$. In this way, a single $V_L$ segment (e.g., $V_L1$) can be combined with two different $V_H$ domains (e.g., $V_H1$ and $V_H2$) to generate a bi-specific comprised of two binding "arms" ($V_H1$-$V_L1$ and $V_H2$-$V_L1$). Use of a single $V_L$ segment reduces the complexity of the system and thereby simplifies and increases efficiency in cloning, expression, and purification processes used to generate the bi-specific.

The bi-specific binders are tested for binding and functional blocking of $Na_v1.7$ in any of the assays described above for antibodies. For example, binding of bi-specific antibodies to cells expressing $Na_v1.7$ is determined through flow cytometry using a fluorescently labeled secondary antibody recognizing anti-$Na_v1.7$ bi-specific antibodies bound to cells. Cross-reactivity to the different $Na_v1.7$ loops within and between different species variants is assessed using an ELISA binding assay in which synthetic peptides representing the different loops are coated onto the wells of microtiter plates, and binding of a bi-specific is determined through use of a secondary detection antibody. Binding experiments with loop peptides can also be conducted using surface plasmon resonance experiments, in which real-time binding interaction of peptide to antibody is measured by flowing a peptide or bi-specific across a sensor surface on which bi-specific or peptide, respectively, is captured. Functional in vitro blocking of the $Na_v1.7$ channel by a bi-specific is determined using a patch-clamp assay, in which a bi-specific inhibits the voltage-stimulated depolarization of a $Na_v1.7$-expressing cell. In vivo models, including acute nociception and Carrageenan models described above, will be used to assess efficacy in vivo.

SEQUENCE LISTING (874 sequences)

SEQ ID NO: 1 - DNA, 363 bp, Artificial Sequence
  Synthetic
caggtgcagttggtggagtctgggggaggcgtggtccagcctgggaggtccctgagtctctcctgtgcagcctctggattcaccttcagtaactatggcatgcattgggtccgccaggctccaggcaaggggctggagtgggtggcagccatatcatatgatggaaatactaaatactatgtagactccgtgaagggccgattcaccatctccagagacaattccaagaacacgctctatctgcaaatgaatagcctgagaggtgaggacatggctgtgtattactgtgtaggagctcgtccgggatacgaccactacggtatggacgtctggggccaagggaccacggtcaccgtctcctca

SEQ ID NO: 2 - protein, 121 aa, Artificial Sequence
  Synthetic
QVQLVESGGGVVQPGRSLSLSCAASGFTFSNYGMHWVRQAPGKGLEWVAAISYDGNTKYYVDSVKGRFTISRDNSKNTLYLQMNSLRGEDMAVYYCVGARPGYDHYGMDVWGQGTTVTVSS

SEQ ID NO: 3 - DNA, 321 bp, Artificial Sequence
  Synthetic
gacatccagttgacccagtctccatccttcctgtctacatctgtaggagacagagtcaccatcacttgctgggccagtcagggcattagcagttatttagcctggtatcagcaaaaaccagggaaagcccctaacctcctgatctatactgcatccactttacaaagtggggtcccatcaaggttcagcggcagtggatctgggacagaattcactctcacaatcagcagcctgcagcctgaagattttgcaacttattactgtcaacaacttaatagttacccgtacacttttggccaggggaccaaactggagatcaaa

SEQ ID NO: 4 - protein, 107 aa, Artificial Sequence
  Synthetic
DIQLTQSPSFLSTSVGDRVTITCWASQGISSYLAWYQQKPGKAPNLLIYTASTLQSGVPSRFSGSGSGTEFTLTISSLQPEDFATYYCQQLNSYPYTFGQGTKLEIK

SEQ ID NO: 5 - DNA, 354 bp, Artificial Sequence
  Synthetic
caggtgcaactggtggagtctgggggaggcgtggtccagcctgggaggtccctgagactctcctgtgcagcctctggattcaccttcagtagttatggcatgcactgggtccgccaggctccaggcaagggactggagtgggtggcagttatatcatatgatggaaataataaacactttgcagactcagtgaagggccgattcaccatctccagagacaattccaagaacacgctgaatctacaaatgaacagcctgagagctgaggacagggctgtttattattgtgcgagaggggccagtggctttgttcttgatatctggggccaagggacaatggtcaccgtctcttca

SEQ ID NO: 6 - protein, 118 aa, Artificial Sequence
  Synthetic
QVQLVESGGGVVQPGRSLRLSCAASGFTFSSYGMHWVRQAPGKGLEWVAVISYDGNNKHFADSVKGRFTISRDNSKNTLNLQMNSLRAEDRAVYYCARGASGFVLDIWGQGTMVTVSS

SEQ ID NO: 7 - DNA, 336 bp, Artificial Sequence
  Synthetic
gatattgtaatgacccagactccactctcctcacctgtcacccttggacagccggcctccatctcctgcaggtctagtcaaagcctcgtacgcagtgatggaaatacctacttgagttggcttcagcagaggccgggccagcctccaagactcctaatttataagatttctaaccggttctctggggtcccagacagattcagtggcagtggggcagggacagatttcacactgaaaatcagcagggtggaagctgaggatgtcgggatttatttctgcatgcaaactacacaatttccattcactttcggccctgggaccaaagtggatatcaaa

SEQ ID NO: 8 - protein, 112 aa, Artificial Sequence
  Synthetic
DIVMTQTPLSSPVTLGQPASISCRSSQSLVRSDGNTYLSWLQQRPGQPPRLLIYKISNRFSGVPDRFSGSGAGTDFTLKISRVEAEDVGIYFCMQTTQFPFTFGPGTKVDIK

SEQ ID NO: 9 - DNA, 354 bp, Artificial Sequence
  Synthetic
caggtgcagctggtggagtcggggggaggcgtggtccagcctgggaggtcccagagactctcctgtgcagcctctggattcaccttcagtcactatggaatgcattgggtccgccaggctccaggcaaggggctggagtgggtggcagttatatcatatgatggaaataataaacactatgcagactccgtgaagggccgattcaccacctccagagacaattccaagaatacgctgtttctgcaaatgaacagcctgagagctgaggacacggctgtgtattactgtgcccgtggatatagtggctacgtccttgactactggggccagggaaccctggtcaccgtctcctca

SEQ ID NO: 10 - protein, 118 aa, Artificial Sequence
  Synthetic
QVQLVESGGGVVQPGRSQRLSCAASGFTFSHYGMHWVRQAPGKGLEWVAVISYDGNNKHYADSVKGRFTTSRDNSKNTLFLQMNSLRAEDTAVYYCARGYSGYVLDYWGQGTLVTVSS

SEQ ID NO: 11 - DNA, 336 bp, Artificial Sequence
  Synthetic
gatattgtgatgacccagactccactctcctcacctgtcacccttggacagccggcctccatctcctgcaggtctagtcaaagcctcgtaaaaagtgatggaaatacctacttgagttggcttcagcagaggccaggccagcctccaagactcctaatttataagatttctaaccggttctctggggtcccagacagattcagtggcagtggggcagggacagatttcacactgaaaatcagcagggtggaagctgaggatgtcggggtttattactgcatgcaaactacacagtttccattcactttcggccctgggaccaaagtggatatcaaa

SEQ ID NO: 12 - protein, 112 aa, Artificial Sequence
  Synthetic
DIVMTQTPLSSPVTLGQPASISCRSSQSLVKSDGNTYLSWLQQRPGQPPRLLIYKISNRFSGVPDRFSGSGAGTDFTLKISRVEAEDVGVYYCMQTTQFPFTFGPGTKVDIK

SEQ ID NO: 13 - DNA, 354 bp, Artificial Sequence
  Synthetic
caggtgcagctggtggagtctgggggaggcgtggtccagcctgggaggtccctgagactctcctgtgcagcctctggattcaccttcagtaactatggaatgcattgggtccgccaggctccaggcaaggggctggagtgggtggcagtcacatcatatgatggaagtaataaacactatgcagactccgtgaagggccgattcagcacctccagagacaatcccaagaacacgctgtatctgcaaatggacagcctgagaggtgaggacacggctgtgtattactgtgcccgtggatatagtggcttcgtccttgacaactggggccagggaaccctggtcaccgtctcctca

SEQ ID NO: 14 - protein, 118 aa, Artificial Sequence
  Synthetic
QVQLVESGGGVVQPGRSLRLSCAASGFTFSNYGMHWVRQAPGKGLEWVAVTSYDGSNKHYADSVKGRFSTSRDNPKNTLYLQMDSLRGEDTAVYYCARGYSGFVLDNWGQGTLVTVSS

SEQ ID NO: 15 - DNA, 336 bp, Artificial Sequence
  Synthetic
gatattgtgatgacccagactccactctcctcacctgtcacccttggacagccggcctccatctcctgcaggtctagtcaaagcctcgtaaaaagtgatggaaatacctacttgagttggcttcagcagaggccaggccagcctccaagactcctaatttataagatttctaaccggttctctggggtcccagacagattcagtggcagtggggcagggacagatttcacactgaaaatcagcagggtggaagctgaggatgtcgggatttattattgtatgcaaactacacaatttccattcactttcggccctgggaccaaagtggatatcaaa

SEQ ID NO: 16 - protein, 112 aa, Artificial Sequence
  Synthetic
DIVMTQTPLSSPVTLGQPASISCRSSQSLVKSDGNTYLSWLQQRPGQPPRLLIYKISNRFSGVPDRFSGSGAGTDFTLKISRVEAEDVGIYYCMQTTQFPFTFGPGTKVDIK

SEQ ID NO: 17 - DNA, 369 bp, Artificial Sequence
  Synthetic
caggtgcagttggtggagtctgggggaggcgtggtccagcctgggaggtccctgacactctcctgtgcagcgtctggattcatgttcaatagatttggcatgcactgggtccgccaggctccaggcaaggggctggactgggtggcagttatatggtatgatggaagtaataaatactatgcagactccgtgaagggccgattcaccatctccagagacaattccaagaatacgttgtatctgcaagtgaacagcctgagagccgaggacacggctgtgtattactgtgcgagagagggcaccccccattactacgatagtagcggccttgactactggggccagggaaccctggtcaccgtctcctca

SEQ ID NO: 18 - protein, 123 aa, Artificial Sequence
  Synthetic
QVQLVESGGGVVQPGRSLTLSCAASGFMFNRFGMHWVRQAPGKGLDWVAVIWYDGSNKYYADSVKGRFTISRDNSKNTLYLQVNSLRAEDTAVYYCAREGTPHYYDSSGLDYWGQGTLVTVSS

SEQ ID NO: 19 - DNA, 321 bp, Artificial Sequence
  Synthetic
gccatccagatgacccagtctccatcctccctgtctgcatatgtaggggacagagtcaccatcacttgccgggcaagtcaggacattagaaatgatttaggctggtatcagcagaaaccagggaaagcccctaatctcctgatctatgatatatccagtttacaaagtggggtcccatcaaggttcagcggcagtggatctggcacagatttcactctcaccatcagcagcctgcagcctgaagattttgcaacttattactgtctacaagattacaattacccgctcactttcggcggagggaccaaggtggagatcaaa

SEQ ID NO: 20 - protein, 107 aa, Artificial Sequence
  Synthetic
AIQMTQSPSSLSAYVGDRVTITCRASQDIRNDLGWYQQKPGKAPNLLIYDISSLQSGVPSRFSGSGSGTDFTLTISSLQPEDFATYYCLQDYNYPLTFGGGTKVEIK

SEQ ID NO: 21 - DNA, 354 bp, Artificial Sequence; identical to SEQ ID NO: 9
  Synthetic

SEQ ID NO: 22 - protein, 118 aa, Artificial Sequence; identical to SEQ ID NO: 10
  Synthetic

SEQ ID NO: 23 - DNA, 336 bp, Artificial Sequence; identical to SEQ ID NO: 11
  Synthetic

SEQ ID NO: 24 - protein, 112 aa, Artificial Sequence; identical to SEQ ID NO: 12
  Synthetic

SEQ ID NO: 25 - DNA, 372 bp, Artificial Sequence
  Synthetic
gaggtacagctggtggagtctgggggaggcttggtccagcctggggggtccctgagactctcctgtgcagcctctggattcacctttagtatcttctggatgaactgggtccgccaggctccagggaaggggctggagtgggtggccaagataaagcaagatggaagtgagaaatactatgtggactctatgaagggccgattcaccatctccagagacaacgtcaagaactcactgtatctgcaaatgaacagcctgagagccgaggacacggctgtgtattactgtgcgagaggcgtttgggggagttatcgttatacctctagtggtttggacgtctggggccaagggaccacggtcaccgtctcctca

SEQ ID NO: 26 - protein, 124 aa, Artificial Sequence
  Synthetic
EVQLVESGGGLVQPGGSLRLSCAASGFTFSIFWMNWVRQAPGKGLEWVAKIKQDGSEKYYVDSMKGRFTISRDNVKNSLYLQMNSLRAEDTAVYYCARGVWGSYRYTSSGLDVWGQGTTVTVSS

SEQ ID NO: 27 - DNA, 339 bp, Artificial Sequence
  Synthetic
gatattgtgatgactcagtctccactctccctgcccgtcacccctggagagccggcctccatctcctgcaggtctagtcagagcctcctgcacagtaatggatacaattatttggattggtacctgcagaagacagggcagtctccacaactcctgatctatttgggttctaatcgggcctccggggtccctgacaggttcagtggcagtggatcaggcacagattttacactgaaaatcagcagagtggaggctgaggatgttgggatttattactgcatgcaagctctacaagctctcccattcactttcggccctgggaccaaagtggatatcaaa

SEQ ID NO: 28 - protein, 113 aa, Artificial Sequence
  Synthetic
DIVMTQSPLSLPVTPGEPASISCRSSQSLLHSNGYNYLDWYLQKTGQSPQLLIYLGSNRASGVPDRFSGSGSGTDFTLKISRVEAEDVGIYYCMQALQALPFTFGPGTKVDIK

SEQ ID NO: 29 - DNA, 351 bp, Artificial Sequence
  Synthetic
caggtgcagctggtggagtctggagctgaggtgaagaagcctggggcctcagtgaaggtctcctgcaaggcttctggttacacctttaccacctatggtatctcctgggtgcgacaggcccctggacaagggcttgagtggatgggatggatcagcgcttacaatggtaaaacaaactatgcacagaagttccagggcagagtcaccatgaccacagacacatccacgaacacagcctacatggagctgaggagcctgagatttgacgacacggccgtgtattactgtgcgagagacggtggaactcctttttactactggggccagggaaccctggtcaccgtctcctca

SEQ ID NO: 30 - protein, 117 aa, Artificial Sequence
  Synthetic
QVQLVESGAEVKKPGASVKVSCKASGYTFTTYGISWVRQAPGQGLEWMGWISAYNGKTNYAQKFQGRVTMTTDTSTNTAYMELRSLRFDDTAVYYCARDGGTPFYYWGQGTLVTVSS

SEQ ID NO: 31 - DNA, 342 bp, Artificial Sequence
  Synthetic
gacatccagatgacccagtctccagactccctggctgtgtctctgggcgagagggccaccatcaactgcaagtccagccagagtgttttatacagctccaacaataagaactacttaggttggtaccagcagaaagcaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatggtattccgtggacgttcggccaagggaccaaggtggagatcaaacga

SEQ ID NO: 32 - protein, 114 aa, Artificial Sequence
  Synthetic
DIQMTQSPDSLAVSLGERATINCKSSQSVLYSSNNKNYLGWYQQKAGQPPKLLIYWASTRESGVPDRFSGSGSGTDFTLTISSLQAEDVAVYYCQQYYGIPWTFGQGTKVEIKR

SEQ ID NO: 33 - DNA, 357 bp, Artificial Sequence
  Synthetic
caggtgcagctggtgcagtctgggggaggcgtggtccagcctgggaggtccctgagactctcctgtgcagcctctggattctccttcagtagctttggcatgcactgggtccgccaggctccaggcaaggggctggagtgggtggcagttatatcatatggtggaattaataaacactattcagactccgtgaagggccggttcaccatctccagagacgattccaagaacacgctctatctgcaaatgaacagcctgagagctgaggacacggctgtctattactgtgcgaaaagggagggatacaggtatgcttacgactactggggccagggaaccctggtcaccgtctcctca

SEQ ID NO: 34 - protein, 119 aa, Artificial Sequence
  Synthetic
QVQLVQSGGGVVQPGRSLRLSCAASGFSFSSFGMHWVRQAPGKGLEWVAVISYGGINKHYSDSVKGRFTISRDDSKNTLYLQMNSLRAEDTAVYYCAKREGYRYAYDYWGQGTLVTVSS

SEQ ID NO: 35 - DNA, 324 bp, Artificial Sequence
  Synthetic
gacatccagatgacccagtctccatcctcactgtctgcatctgtaggagacagagtcaccatcacttgtcgggcgagtcagggcattagcaattatttagcctggtttcagcagaaaccagggaaagcccctaagtccctgatctatggtgcatccagtttgcaaagtggggtcccatcaaagttcagcggcagtggatctgggacagatttcactctcaccatcagcagcctgcagcctgaagattttgcaacttattactgccaacagtataatagttacccgctcactttcggcggggggaccaaggtggaaatcaaacga

SEQ ID NO: 36 - protein, 108 aa, Artificial Sequence
  Synthetic
DIQMTQSPSSLSASVGDRVTITCRASQGISNYLAWFQQKPGKAPKSLIYGASSLQSGVPSKFSGSGSGTDFTLTISSLQPEDFATYYCQQYNSYPLTFGGGTKVEIKR

SEQ ID NO: 37 - DNA, 357 bp, Artificial Sequence
  Synthetic
gaggtgcagctggtgcagtctgggggaggcgtggtccagcctgggaggtccctgagactctcctgtgcagcctctggattcaccttcagtagctatggcatgcactgggtccgccaggctccaggcaaggggctggagtgggtggcagttatttcatatcaggaaagtaataaacactatgtagactccgtgaagggccgattcaccatctccagagacaattccaagaacacgctgtatctgcaaatgaacagcctgagagctgaggacacggctgtgtattactgtgcgaaaagtcgtggatacagctatggtctaggttactggggccagggaaccctggtcaccgtctcctca

SEQ ID NO: 38 - protein, 119 aa, Artificial Sequence
  Synthetic
EVQLVQSGGGVVQPGRSLRLSCAASGFTFSSYGMHWVRQAPGKGLEWVAVISYQESNKHYVDSVKGRFTISRDNSKNTLYLQMNSLRAEDTAVYYCAKSRGYSYGLGYWGQGTLVTVSS

SEQ ID NO: 39 - DNA, 342 bp, Artificial Sequence
  Synthetic
gacatccagatgacccagtctccagactccctggctgtgtctctgggcgagagggccaccatcaactgcaagtccagccagagtgttttatacagctccaacaataagaactacttaacttggtaccagcagaaaccaggacagcctcctaaactgctcatttactggacatctacccgggaatccggggtccctgaccgattcagtggcagcgggtctgggacagatttcactctcaccatcagcagcctgcaggctgaagatgtggcagtttattactgtcagcaatattatagtactccgtacacttttggccaggggaccaaggtggaaatcaaacga

SEQ ID NO: 40 - protein, 114 aa, Artificial Sequence
  Synthetic
DIQMTQSPDSLAVSLGERATINCKSSQSVLYSSNNKNYLTWYQQKPGQPPKLLIYWTSTRESGVPDRFSGSGSGTDFTLTISSLQAEDVAVYYCQQYYSTPYTFGQGTKVEIKR

SEQ ID NO: 41 - DNA, 357 bp, Artificial Sequence
  Synthetic
gaggtgcagctggtgcagtctgggggaggcgtggtccagcctgggaggtccctgagactctcctgtgaagcctctggattcaccttcagtagctatggcatgcactgggtccgccaggctccaggcaaggggctggagtgggtggcagttatatcatatgatggaagtaataaacactatacagactccgtgaagggccgattcaccatctccagagacaattccaagaacacgctgtatctgcaaatgaacagcctgagagctgaggacacggctgtgtatttctgtgcgcaaagtcgtggatacagctatggtctaggctactggggccagggaaccctggtcaccgtctcctca

SEQ ID NO: 42 - protein, 119 aa, Artificial Sequence
  Synthetic
EVQLVQSGGGVVQPGRSLRLSCEASGFTFSSYGMHWVRQAPGKGLEWVAVISYDGSNKHYTDSVKGRFTISRDNSKNTLYLQMNSLRAEDTAVYFCAQSRGYSYGLGYWGQGTLVTVSS

SEQ ID NO: 43 - DNA, 342 bp, Artificial Sequence
  Synthetic
gacatccagatgacccagtctccagactccctggctgtgtctctgggcgagagggccaccatcaactgcaagtccagccagagtgttttatccagttccaacaatgagaactacttagtttggtaccagcagaaaccaggacagcctcctaagttgctcatttactgggcatctacccgggaacccggggtccctgaccgattcagtggcggcgggtctgggacagatttcactctcaccatcagcagcctgcaggctgaagatgtggcagtttattactgtcagcaatatcatagtattccgtacacttttggccaggggaccaaggtggagatcaaacga

SEQ ID NO: 44 - protein, 114 aa, Artificial Sequence
  Synthetic
DIQMTQSPDSLAVSLGERATINCKSSQSVLSSSNNENYLVWYQQKPGQPPKLLIYWASTREPGVPDRFSGGGSGTDFTLTISSLQAEDVAVYYCQQYHSIPYTFGQGTKVEIKR

SEQ ID NO: 45 - DNA, 357 bp, Artificial Sequence
  Synthetic
caggtgcagctggtgcagtctgggggaggcgtggtccagcctgggaggtccctgagactctcctgtgcagcctctggattcaccttcagtagttatggcatgcactgggtccgccaggctccaggcaaggggctggagtgggtggcagttatatcatatgaaggaagtaacaaacactatgcagactccgtgaagggccgattcaccatctccagagacaattccaagaacacgttgtatctgcaaatgaacagcctgagagctgaggacacggctgtgttttactgtgcgcaaagtcgtggatacagctatggtctaggctactggggccagggaaccctggtcaccgtctcctca

SEQ ID NO: 46 - protein, 119 aa, Artificial Sequence
  Synthetic
QVQLVQSGGGVVQPGRSLRLSCAASGFTFSSYGMHWVRQAPGKGLEWVAVISYEGSNKHYADSVKGRFTISRDNSKNTLYLQMNSLRAEDTAVFYCAQSRGYSYGLGYWGQGTLVTVSS

SEQ ID NO: 47 - DNA, 342 bp, Artificial Sequence
  Synthetic
gacatccagatgacccagtctccagactccctggctgtgtctctgggcgagagggccaccatcaactgcaagtccagccagagtgttttatccagctccaacaataagaactacttaacatggtaccagcagaaaccaggacagcctcctaagttgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtacacttttggccaggggaccaaggtggaaatcaaacga

SEQ ID NO: 48 - protein, 114 aa, Artificial Sequence
  Synthetic
DIQMTQSPDSLAVSLGERATINCKSSQSVLSSSNNKNYLTWYQQKPGQPPKLLIYWASTRESGVPDRFSGSGSGTDFTLTISSLQAEDVAVYYCQQYYSTPYTFGQGTKVEIKR

SEQ ID NO: 49 - DNA, 357 bp, Artificial Sequence
  Synthetic
caggtgcagctggtggagtctgggggaggcgtggtccagcctgggaggtccctgagactctcctgtgcagcctctggattcaccttcagtagttatggcatgcactgggtccgccaggctccaggcaaggggctggagtgggtggcagttatatcatatgaaggaagtaacaaacactatgcagactccgtgaagggccgattcaccatctccagagacaattccaagaacacgttgtatctgcaaatgaacagcctgagagctgaggacacggctgtgttttactgtgcgcaaagtcgtggatacagctatggtctaggctactggggccagggaaccctggtcaccgtctcctca

SEQ ID NO: 50 - protein, 119 aa, Artificial Sequence
  Synthetic
QVQLVESGGGVVQPGRSLRLSCAASGFTFSSYGMHWVRQAPGKGLEWVAVISYEGSNKHYADSVKGRFTISRDNSKNTLYLQMNSLRAEDTAVFYCAQSRGYSYGLGYWGQGTLVTVSS

SEQ ID NO: 51 - DNA, 339 bp, Artificial Sequence
  Synthetic
gacatcgtgatgacccagtctccagactccctggctgtgtctctgggcgagagggccaccatcaactgcaagtccagccagagtgttttatccagctccaacaataagaactacttaacatggtaccagcagaaaccaggacagcctcctaagttgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtacacttttggccaggggaccaagctggagatcaaa

SEQ ID NO: 52 - protein, 113 aa, Artificial Sequence
  Synthetic
DIVMTQSPDSLAVSLGERATINCKSSQSVLSSSNNKNYLTWYQQKPGQPPKLLIYWASTRESGVPDRFSGSGSGTDFTLTISSLQAEDVAVYYCQQYYSTPYTFGQGTKLEIK

SEQ ID NO: 53 - DNA, 357 bp, Artificial Sequence
  Synthetic
caggtgcagctggtgcagtctgggggaggcgtggtccagcctgggaggtccctgagactctcctgtgcagcctctggattcaccttcagtagctatggcatgcactgggtccgccaggctccaggcaaggggctggagtgggtggcacttatatcatatgctggaattaatgaatactatgcagactccgtgaagggccgattcaccatttccagagacgattccaagaacacgctgtatctgcaaatgaacagcctgagagttgaggacacggctgtgtattactgtgcgaaaagtcgtggatacagctatggtctaggctactggggccagggaaccctggtcactgtctcctca

SEQ ID NO: 54 - protein, 119 aa, Artificial Sequence
  Synthetic
QVQLVQSGGGVVQPGRSLRLSCAASGFTFSSYGMHWVRQAPGKGLEWVALISYAGINEYYADSVKGRFTISRDDSKNTLYLQMNSLRVEDTAVYYCAKSRGYSYGLGYWGQGTLVTVSS

SEQ ID NO: 55 - DNA, 342 bp, Artificial Sequence
  Synthetic
gacatccagatgacccagtctccagactccctggctgtgtctctgggcgagagggccaccatcaactgcaagtccagccagagtgttttatacagctccaacaataagaactacttagtttggtaccagcagaaaccaggacagcctcctaacctgctcatttactgggcatctacccgggaatccggggtccctgaccgattcagtggcagcgggtctgggacagatttcactctcaccatcagcagcctgcaggctgaagatgtggcagtttattactgtcagcaatattataatcctccgtacacttttggccaggggaccaaggtggagatcaaacga

SEQ ID NO: 56 - protein, 114 aa, Artificial Sequence
  Synthetic
DIQMTQSPDSLAVSLGERATINCKSSQSVLYSSNNKNYLVWYQQKPGQPPNLLIYWASTRESGVPDRFSGSGSGTDFTLTISSLQAEDVAVYYCQQYYNPPYTFGQGTKVEIKR

SEQ ID NO: 57 - DNA, 357 bp, Artificial Sequence
  Synthetic
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatttcatatcaggaaagtaataaacactatgtagactccgtgaagggccgattcaccatctccagagacaattccaagaacacgctgtatctgcaaatgaacagtttgagagctgaggacacggctgtgtattactgtgcgcaaagtcgtggatacagctatggtctaggttactggggccagggaaccctggtcaccgtctcctca

SEQ ID NO: 58 - protein, 119 aa, Artificial Sequence
  Synthetic
QVQLVESGGGVVQPGRSLRLSCAASGFTFSSYGMHWVRQAPGKGLEWVAVISYQESNKHYVDSVKGRFTISRDNSKNTLYLQMNSLRAEDTAVYYCAQSRGYSYGLGYWGQGTLVTVSS

SEQ ID NO: 59 - DNA, 324 bp, Artificial Sequence
  Synthetic
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcaccatcagcagcctgcagcctgaagattttgcaacttattactgtcaacagcataatagttacccgctcactttcggccaagggaccaaggtggagatcaaacga

SEQ ID NO: 60 - protein, 108 aa, Artificial Sequence
  Synthetic
DIQMTQSPSSLSASVGDRVTITCRASQGIRNDLGWYQQKPGKAPKRLIYAASSLQSGVPSRFSGSGSGTEFTLTISSLQPEDFATYYCQQHNSYPLTFGQGTKVEIKR

SEQ ID NO: 61 - DNA, 384 bp, Artificial Sequence
  Synthetic
gaggtgcagctggtgcagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagtataggctatgcggactctgtgaagggccgattcaccagctccagagacaacgccaagaactccctgtatctgcaaatgaacagtctgagagctgaggacacggccctgtattactgtgcaaaagatatggaatattacgatattttgactggttattatagctactacattatggacgtctggggccaagggaccacggtcaccgtctcctca

SEQ ID NO: 62 - protein, 128 aa, Artificial Sequence
  Synthetic
EVQLVQSGGGLVQPGRSLRLSCAASGFTFDDYAMHWVRQAPGKGLEWVSGISWNSGSIGYADSVKGRFTSSRDNAKNSLYLQMNSLRAEDTALYYCAKDMEYYDILTGYYSYYIMDVWGQGTTVTVSS

SEQ ID NO: 63 - DNA, 324 bp, Artificial Sequence
  Synthetic
gacatccagatgacccagtctccatccttcctgtctgcatctgtaggagacagagtcaccatcacttgctgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagtttaatagttaccctccgacgttcggccaagggaccaaggtggaaatcaaacga

SEQ ID NO: 64 - protein, 108 aa, Artificial Sequence
  Synthetic
DIQMTQSPSFLSASVGDRVTITCWASQGISSYLAWYQQKPGKAPKLLIYAASTLQSGVPSRFSGSGSGTEFTLTISSLQPEDFATYYCQQFNSYPPTFGQGTKVEIKR

SEQ ID NO: 65 - DNA, 363 bp, Artificial Sequence
  Synthetic
caggtacagctgcagcagtggggcgcaggactgttgaagccttcggagaccctgtccctcacctgcgctgtctatggtgggtccttcagtggtcactactggagctggatccggcagcccccagggaaggggctggagtggattggggaaatcaatcatagaggaagcaccaactataacccgtccctcaagagtcgagccaccatatcagtagacacgtccaagaaccagttctccctgaagctgagctctgtgaccgccgcggacacggctgtgtattactgtgcgagagagggtagtttggcagctcgtctctggtttttcgatctctggggccgtgataccctggtcactgtctcctca

SEQ ID NO: 66 - protein, 121 aa, Artificial Sequence
  Synthetic
QVQLQQWGAGLLKPSETLSLTCAVYGGSFSGHYWSWIRQPPGKGLEWIGEINHRGSTNYNPSLKSRATISVDTSKNQFSLKLSSVTAADTAVYYCAREGSLAARLWFFDLWGRDTLVTVSS

SEQ ID NO: 67 - DNA, 324 bp, Artificial Sequence
  Synthetic
gacatccagatgacccagtctccatcctccctgtctgcatctgtaggagacagaggcaccatcacttgccgggcaagtcaggacattcgcacctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacggtaccccgtacacttttggccaggggaccaaggtggagatcaaacga

SEQ ID NO: 68 - protein, 108 aa, Artificial Sequence
  Synthetic
DIQMTQSPSSLSASVGDRGTITCRASQDIRTYLNWYQQKPGKAPKLLIYAASSLQSGVPSRFSGSGSGTDFTLTISSLQPEDFATYYCQQSYGTPYTFGQGTKVEIKR

SEQ ID NO: 69 - DNA, 363 bp, Artificial Sequence
  Synthetic
caggtacagctgcagcagtcgggcgcaggactgttgaagccttcggagaccctgtccctcacctgcgctgtctatggtgggtccttcagtggtcactactggagctggatccggcagcccccagggaaggggctggagtggattggggaaatcaatcatagaggaagcaccaactataacccgtccctcaagagtcgagccaccatatcagtagacacgtccaagaaccagttctccctgaagctgagctctgtgaccgccgcggacacggctgtgtattactgtgcgagagagggtagtttggcagctcgtctctggtttttcgatctctggggccgtgataccctggtcactgtctcctca

SEQ ID NO: 70 - protein, 121 aa, Artificial Sequence
  Synthetic
  VARIANT (7)...(7): Xaa = Trp or Ser
  VARIANT 7: Xaa = Any Amino Acid
  VARIANT 7: Xaa = Any Amino Acid
  VARIANT 7: Xaa = Any Amino Acid
QVQLQQXGAGLLKPSETLSLTCAVYGGSFSGHYWSWIRQPPGKGLEWIGEINHRGSTNYNPSLKSRATISVDTSKNQFSLKLSSVTAADTAVYYCAREGSLAARLWFFDLWGRDTLVTVSS

SEQ ID NO: 71 - DNA, 321 bp, Artificial Sequence
  Synthetic
gacatccagatgacccagtctccatcctccctgtctgcatctgtaggagacagaggcaccatcacttgccgggcaagtcaggacattcgcacctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacggtaccccgtacacttttggccaggggaccaagctggagatcaaa

SEQ ID NO: 72 - protein, 107 aa, Artificial Sequence
  Synthetic
DIQMTQSPSSLSASVGDRGTITCRASQDIRTYLNWYQQKPGKAPKLLIYAASSLQSGVPSRFSGSGSGTDFTLTISSLQPEDFATYYCQQSYGTPYTFGQGTKLEIK

SEQ ID NO: 73 - DNA, 384 bp, Artificial Sequence
  Synthetic
caggtgcagctggtggagtctgggggaggcttggtacagcctggcaggtccctgagactctcctgtgcagcctctggattcacctttgatgattatgccatgcactgggtccggcaagttccagggaagggcctggagtgggtctcaggtattaattggaatagtggtagcataggctatgcggactctgtgaagggccgattcaccatctccagagacaacgccaagaactccctgtttctgcaaatgaacagtctgagagctgaggacacggccttgtattactgtgcgaaagatatagagtattacgatattttgactggttattatagctactacattatggacgtctggggccaagggaccacggtcaccgtctcctca

SEQ ID NO: 74 - protein, 128 aa, Artificial Sequence
  Synthetic
QVQLVESGGGLVQPGRSLRLSCAASGFTFDDYAMHWVRQVPGKGLEWVSGINWNSGSIGYADSVKGRFTISRDNAKNSLFLQMNSLRAEDTALYYCAKDIEYYDILTGYYSYYIMDVWGQGTTVTVSS

SEQ ID NO: 75 - DNA, 324 bp, Artificial Sequence
  Synthetic
gacatccagatgacccagtctccatccttcctgtctgcatctgtaggagacagagtcaccatcacttgctgggccagtcagggcattagcagttatttagcctggtatcagcaaaaaccagggaaagcccctaagctcctgatttatgcttcatccactttgcaaagtggggtcccatccaggttcagcggcagtggatctgggacagaattcactctcacaatcagcagcctgcagcctgaagattttgcaacttattactgtcaacagtttaatagttaccctccgacgttcggccaagggaccaaggtggaaatcaaacga

SEQ ID NO: 76 - protein, 108 aa, Artificial Sequence
  Synthetic
DIQMTQSPSFLSASVGDRVTITCWASQGISSYLAWYQQKPGKAPKLLIYASSTLQSGVPSRFSGSGSGTEFTLTISSLQPEDFATYYCQQFNSYPPTFGQGTKVEIKR

SEQ ID NO: 77 - DNA, 384 bp, Artificial Sequence
  Synthetic
gaggtgcagctggtgcagtctgggggaggcttggtacagcctggcaggtccctgagactctcctgtgcagcctctggattcacctttgatgattatgcaatgcactgggtccggcaagctccagggaagggcctggagtgggtctcaggtattagttggaacagtggtagcataggctatgcggactctgtgaagggccgattcaccatctccagagacaacgccaagaattcactgtatctgcaaatgaacagtctgagagctgaggacacggccttgtattattgtgcaaaagatatagagtattacgatattttgactggttattatagctactacattatggacgtctggggccaagggaccacggtcaccgtctcctca

SEQ ID NO: 78 - protein, 128 aa, Artificial Sequence
  Synthetic
EVQLVQSGGGLVQPGRSLRLSCAASGFTFDDYAMHWVRQAPGKGLEWVSGISWNSGSIGYADSVKGRFTISRDNAKNSLYLQMNSLRAEDTALYYCAKDIEYYDILTGYYSYYIMDVWGQGTTVTVSS

SEQ ID NO: 79 - DNA, 324 bp, Artificial Sequence
  Synthetic
gacatccggatgacccagtctccatcctccctgtctgcatctgtaggagacagaggcaccatcacttgccgggcaagtcagaacattaacagctatttaaattggtatcagctgaaaccagggaaagcccctaaactcctgatctttgctgcatccagtttgcaaagtggggtcccatcaaggttcagtggcagtggatctgggacagatttcactctcaccatcagcagtctgcaacctgaagattttgcaacttactactgtcaacagagttacagttccccgttcacttttggccaggggaccaaggtggaaatcaaacga

SEQ ID NO: 80 - protein, 108 aa, Artificial Sequence
  Synthetic
DIRMTQSPSSLSASVGDRGTITCRASQNINSYLNWYQLKPGKAPKLLIFAASSLQSGVPSRFSGSGSGTDFTLTISSLQPEDFATYYCQQSYSSPFTFGQGTKVEIKR

SEQ ID NO: 81 - DNA, 384 bp, Artificial Sequence
  Synthetic
gaggtgcagctggtgcagtctgggggaggcgtggtccagcctgggaggtccctgagactctcctgtacagcgtctggattcaccttcagtgtctatggcatacactgggtccgccaggctccaggcaaggggctggagtgggtggcagttatatggtatgatggaagtaataaatactatacagactccgtgaagggccgattcaccatctccagagacaattccaagaacacgctgtatctgcaaatgaacagcctgagagccgaggacacggctctatattactgtgcgagagagggggatcttagcagctcgtccggctccgggggctaccactacgttgtggacgtctggggccaagggaccatggtcaccgtctcttca

SEQ ID NO: 82 - protein, 128 aa, Artificial Sequence
  Synthetic
EVQLVQSGGGVVQPGRSLRLSCTASGFTFSVYGIHWVRQAPGKGLEWVAVIWYDGSNKYYTDSVKGRFTISRDNSKNTLYLQMNSLRAEDTALYYCAREGDLSSSSGSGGYHYVVDVWGQGTMVTVSS

SEQ ID NO: 83 - DNA, 324 bp, Artificial Sequence
  Synthetic
gacatccagatgacccagtctccatcctccctgtctgcatctgtaggagacagagtcaccatcacttgccgggcaagtcaggacattagaaatgatttaggctggtatcagcagaaaccagggaatgcccctaagctcctgatctattctacatccagtttacaaagtggggtcccatcaaggttcagcggcagtggatctggcacagatttcactctcaccatcagcagcctgcagcctgaagattttgcaacttattactgtctacaagattacaattaccctctcactttcggcggagggaccaaggtggaaatcaaacga

SEQ ID NO: 84 - protein, 108 aa, Artificial Sequence
  Synthetic
DIQMTQSPSSLSASVGDRVTITCRASQDIRNDLGWYQQKPGNAPKLLIYSTSSLQSGVPSRFSGSGSGTDFTLTISSLQPEDFATYYCLQDYNYPLTFGGGTKVEIKR

SEQ ID NO: 85 - DNA, 381 bp, Artificial Sequence
  Synthetic
caggtgcagctggtggagtctgggggaggcgtggtccagcctgggaggtccctgagactctcctgtacagcgtctggattcaccttcagtgtctatggcatacactgggtccgccaggctccaggcaaggggctggagtgggtggcagttatatggtatgatggaagtaataaatactatacagactccgtgaagggccgattcaccatctccagagacaattccaagaacacgctgtatctgcaaatgaacagcctgagagccgaggacacggctctatattactgtgcgagagagggggatcttagcagctcgtccggctccgggggctaccactacgttgtggacgtctggggccaagggaccacggtcaccgtctcc

SEQ ID NO: 86 - protein, 128 aa, Artificial Sequence
  Synthetic
QVQLVESGGGVVQPGRSLRLSCTASGFTFSVYGIHWVRQAPGKGLEWVAVIWYDGSNKYYTDSVKGRFTISRDNSKNTLYLQMNSLRAEDTALYYCAREGDLSSSSGSGGYHYVVDVWGQGTTVTVSS

SEQ ID NO: 87 - DNA, 321 bp, Artificial Sequence
  Synthetic
gccatccagatgacccagtctccatcctccctgtctgcatctgtaggagacagagtcaccatcacttgccgggcaagtcaggacattagaaatgatttaggctggtatcagcagaaaccagggaatgcccctaagctcctgatctattctacatccagtttacaaagtggggtcccatcaaggttcagcggcagtggatctggcacagatttcactctcaccatcagcagcctgcagcctgaagattttgcaacttattactgtctacaagattacaattaccctctcactttcggcggagggaccaaggtggagatcaaa

SEQ ID NO: 88 - protein, 107 aa, Artificial Sequence
  Synthetic
AIQMTQSPSSLSASVGDRVTITCRASQDIRNDLGWYQQKPGNAPKLLIYSTSSLQSGVPSRFSGSGSGTDFTLTISSLQPEDFATYYCLQDYNYPLTFGGGTKVEIK

SEQ ID NO: 89 - DNA, 381 bp, Artificial Sequence
  Synthetic
gaggtgcagctggtggagtctgggggaggcttggtcaagcctggagggtccctgagactctcctgtgcagcctctggagtcaccttcagtgactactacatgacctggatccgccaggctccagggaagggcctggagtgggtttcatacattagtactgatggtcgtaccatatactacgcagactctgtgaagggccgattcaccatctccagggacaacgctaagaactcactgtatctgcaaatgaacaacctgagagccgaggacacggccgtatattactgtgcgagaggggttgactccgatgactacgaggatttctactcctactacgatatggacgtctggggccaagggaccacggtcaccgtctcctca

SEQ ID NO: 90 - protein, 127 aa, Artificial Sequence
  Synthetic
EVQLVESGGGLVKPGGSLRLSCAASGVTFSDYYMTWIRQAPGKGLEWVSYISTDGRTIYYADSVKGRFTISRDNAKNSLYLQMNNLRAEDTAVYYCARGVDSDDYEDFYSYYDMDVWGQGTTVTVSS

SEQ ID NO: 91 - DNA, 324 bp, Artificial Sequence
  Synthetic
gacatccagatgacccagtctccatcctcactgtctgcatctgtaggagacagagtcaccatcacttgtcgggcgagtcagggcattagcaattatttagcctggtttcagcagaaaccagggaaagcccctaagtccctgatctatgctgcatccagtttgcaaggtggggtcccatcaaggttcagcggcagtggatctgggacagatttcactctcaccatcagcagcctgcagcctgaagattttgcaacttattactgccaacagtataatagttaccctctcactttcggcggagggaccaaggtggagatcaaacga

SEQ ID NO: 92 - protein, 108 aa, Artificial Sequence
  Synthetic
DIQMTQSPSSLSASVGDRVTITCRASQGISNYLAWFQQKPGKAPKSLIYAASSLQGGVPSRFSGSGSGTDFTLTISSLQPEDFATYYCQQYNSYPLTFGGGTKVEIKR

SEQ ID NO: 93 - DNA, 378 bp, Artificial Sequence
  Synthetic
caggtgcagctggtggagtctgggggaggcttggtcaagcctggagggtccctgagactctcctgtgcagcctctggagtcaccttcagtgactactacatgacctggatccgccaggctccagggaagggcctggagtgggtttcatacattagtactgatggtcgtaccatatactacgcagactctgtgaagggccgattcaccatctccagggacaacgctaagaactcactgtatctgcaaatgaacaacctgagagccgaggacacggccgtatattactgtgcgagaggggttgactccgatgactacgaggatttctactcctactacgatatggacgtctggggccaagggaccacggtcaccgtctcc

SEQ ID NO: 94 - protein, 127 aa, Artificial Sequence
  Synthetic
QVQLVESGGGLVKPGGSLRLSCAASGVTFSDYYMTWIRQAPGKGLEWVSYISTDGRTIYYADSVKGRFTISRDNAKNSLYLQMNNLRAEDTAVYYCARGVDSDDYEDFYSYYDMDVWGQGTTVTVSS

SEQ ID NO: 95 - DNA, 321 bp, Artificial Sequence
  Synthetic
gacatccagatgacccagtctccatcctcactgtctgcatctgtaggagacagagtcaccatcacttgtcgggcgagtcagggcattagcaattatttagcctggtttcagcagaaaccagggaaagcccctaagtccctgatctatgctgcatccagtttgcaaggtggggtcccatcaaggttcagcggcagtggatctgggacagatttcactctcaccatcagcagcctgcagcctgaagattttgcaacttattactgccaacagtataatagttaccctctcactttcggcggagggaccaaggtggagatcaaa

SEQ ID NO: 96 - protein, 107 aa, Artificial Sequence
  Synthetic
DIQMTQSPSSLSASVGDRVTITCRASQGISNYLAWFQQKPGKAPKSLIYAASSLQGGVPSRFSGSGSGTDFTLTISSLQPEDFATYYCQQYNSYPLTFGGGTKVEIK

SEQ ID NO: 97 - DNA, 357 bp, Artificial Sequence
  Synthetic
caggtgcagctggtggagtctgggggaggcttggtacagccgggggggtccctgagactctcctgtgcagcctctggattcaccttaagtagttatgccatgagctgggtccgccaggctccagggaaggggctggagtgggtctcaactattagtggtagtggtataatatactacacagactccgtgaagggccggttcaccatctccagagacagttccaagaacacgctgtatctgcaaatgaacagcctgagagtcgaggacacggccgtatattactgtgcgaaagatcgtggagcagcagctggagcctttgactactggggccagggaaccctggtcaccgtctcctca

SEQ ID NO: 98 - protein, 119 aa, Artificial Sequence
  Synthetic
QVQLVESGGGLVQPGGSLRLSCAASGFTLSSYAMSWVRQAPGKGLEWVSTISGSGIIYYTDSVKGRFTISRDSSKNTLYLQMNSLRVEDTAVYYCAKDRGAAAGAFDYWGQGTLVTVSS

SEQ ID NO: 99 - DNA, 330 bp, Artificial Sequence
  Synthetic
gccatccagttgacccagtctccagactccctggctgtgtctctgggcgagagggccaccatcaaatgcaagtccagccagagtgttttatacagctccaacaataagaactacttagcttggtaccagcagaaaccaggacagcctcccaacctgctcatttactgggcatctacccgggaatccggggtccctgaccgattcagtggcagcgggtctgggacagatttcactctcaccatcagcagcctgcaggctgaagatgtggcagtttattactgtcagcaatatttctcgttcggccaagggaccaaagtggatatcaaacga

SEQ ID NO: 100 - protein, 110 aa, Artificial Sequence
  Synthetic
AIQLTQSPDSLAVSLGERATIKCKSSQSVLYSSNNKNYLAWYQQKPGQPPNLLIYWASTRESGVPDRFSGSGSGTDFTLTISSLQAEDVAVYYCQQYFSFGQGTKVDIKR

SEQ ID NO: 101 - DNA, 363 bp, Artificial Sequence
  Synthetic
gaggtgcagctggtggagtcgggcccaggactggtgaagtcttcggagaccctgtccctcaaatgcactgtctctggtggctccatcagcagtagtggttactactggggctggatccgccagcccccagggaagggactggagtggattgggagtatccatcgtagtgggagcaccttctacaacccgtccctcaagagtcgagtcaccatatccgttgacacgtccaagagccagttctccctgaggctgacctctgtgaccgccgcagacacgtctgtgtatttctgtgggagacacggacgagactactactacggtatggacgtctggggccaagggaccacggtcaccgtctcctca

SEQ ID NO: 102 - protein, 121 aa, Artificial Sequence
  Synthetic
EVQLVESGPGLVKSSETLSLKCTVSGGSISSSGYYWGWIRQPPGKGLEWIGSIHRSGSTFYNPSLKSRVTISVDTSKSQFSLRLTSVTAADTSVYFCGRHGRDYYYGMDVWGQGTTVTVSS

SEQ ID NO: 103 - DNA, 324 bp, Artificial Sequence
  Synthetic
gacatccagatgacccagtctccatcttccgtgtctgcatctgtaggagacagagtcaccatcacttgtcggtcgagtcaggatattaacaactggttagtctggtatcagcagaaaccagggaaagcccctaaggtcctgatatatggtgcttccagattgcaaagtggggtcccatcaaggttcagtggcagtggatctgggacagatttcactctcaccatcagcagtctgcagcctgaagattttgcaacttactattgtcaacaggctaacagtttcccgctcactttcggcggagggaccaaggtggagatcaaacga

SEQ ID NO: 104 - protein, 108 aa, Artificial Sequence
  Synthetic
DIQMTQSPSSVSASVGDRVTITCRSSQDINNWLVWYQQKPGKAPKVLIYGASRLQSGVPSRFSGSGSGTDFTLTISSLQPEDFATYYCQQANSFPLTFGGGTKVEIKR

SEQ ID NO: 105 - DNA, 363 bp, Artificial Sequence
  Synthetic
gaggtgcagctggtgcagtcgggcccaggactggtgaagtcttcggagaccctgtccctcaaatgcactgtctctggtggctccatcagcagtagtggttactactggggctggatccgccagcccccagggaagggactggagtggattgggagtatccatcgtagtgggagcaccttctacaacccgtccctcaagagtcgagtcaccatatccgttgacacgtccaagagccagttctccctgaggctgacctctgtgaccgccgcagacacgtctgtgtatttctgtgggagacacggacgagactactactacggtatggacgtctggggccaagggaccacggtcaccgtctcctca

SEQ ID NO: 106 - protein, 121 aa, Artificial Sequence
  Synthetic
EVQLVQSGPGLVKSSETLSLKCTVSGGSISSSGYYWGWIRQPPGKGLEWIGSIHRSGSTFYNPSLKSRVTISVDTSKSQFSLRLTSVTAADTSVYFCGRHGRDYYYGMDVWGQGTTVTVSS

SEQ ID NO: 107 - DNA, 324 bp, Artificial Sequence
  Synthetic
gacatccagatgacccagtctccatcttccgtgtctgcatctgtaggagacagagtcaccatcacttgtcggtcgagtcaggatattaacaactggttagtctggtatcagcagaaaccagggaaagcccctaaggtcctgatatatggtgcttccagattgcaaagtggggtcccatcaaggttcagtggcagtggatctgggacagatttcactctcaccatcagcagtctgcagcctgaagattttgcaacttactattgtcaacaggctaacagtttcccgctcactttcggcggagggaccaagctggagatcaaacga

SEQ ID NO: 108 - protein, 108 aa, Artificial Sequence
  Synthetic
DIQMTQSPSSVSASVGDRVTITCRSSQDINNWLVWYQQKPGKAPKVLIYGASRLQSGVPSRFSGSGSGTDFTLTISSLQPEDFATYYCQQANSFPLTFGGGTKLEIKR

SEQ ID NO: 109 - DNA, 363 bp, Artificial Sequence
  Synthetic
gaagtgcagctggtggagtcgggcccaggactggtgaagccttcggagaccctgtccctcaaatgcactgtctctggtggctccatcaggagtagtggttactactggggctggatccgccagcccccagggaaggggctggagtggattgggagtatccatcatagtgggagcacctactacaatccgtccctgaagagtcgagtcaccatatccgttgacacgtccaagagccagttctccctgaggctgacctctgtgaccgccgcagacacggctgtgtattattgtgggagacacggacgagactattattacggaatggacgtctggggccaagggaccacggtcaccgtctcctca

SEQ ID NO: 110 - protein, 121 aa, Artificial Sequence
  Synthetic
EVQLVESGPGLVKPSETLSLKCTVSGGSIRSSGYYWGWIRQPPGKGLEWIGSIHHSGSTYYNPSLKSRVTISVDTSKSQFSLRLTSVTAADTAVYYCGRHGRDYYYGMDVWGQGTTVTVSS

SEQ ID NO: 111 - DNA, 324 bp, Artificial Sequence
  Synthetic
gccatccagttgacccagtctccatcctccctgtctgcatctgtaggagacagagtcaccatcacttgtcgggcgagtcaggatattaacaactggttagtctggtatcagcagaaaccagggaaagcccctaagctcctgatctatgctgcatccagtttacaaagtggggtcccatcaaggttcagtggcagtggatctgggacagatttcactctcaccatcagcagcctgcagcctgaagattttgcaacttactattgtcaacaggctaacagtttcccgctcactttcggcggagggaccaaagtggatatcaaacga

SEQ ID NO: 112 - protein, 108 aa, Artificial Sequence
  Synthetic
AIQLTQSPSSLSASVGDRVTITCRASQDINNWLVWYQQKPGKAPKLLIYAASSLQSGVPSRFSGSGSGTDFTLTISSLQPEDFATYYCQQANSFPLTFGGGTKVDIKR

SEQ ID NO: 113 - DNA, 378 bp, Artificial Sequence
  Synthetic
caggtgcagctggtggagtctgggggaggcttggtacagcctggggggtccctgagactctcctgtgcagcctctggattcacctttagcagctatggcatgagctgggtccgccaggttccagggaaggggctggagtgggtctcagctattagtggtagtggtggtagcacatactacgtagactccgtgaagggccggttcaccatctccagagacaatttcaagaacacgctgtatctgcaaatgaacagcctgagagtcgaggacacggccgtatattactgtgcgaaagatgtgggatattgtagtactaccagctgtaggggtgatgcatttgatgtctggggccaagggacaatggtcaccgtctcttca

SEQ ID NO: 114 - protein, 126 aa, Artificial Sequence
  Synthetic
QVQLVESGGGLVQPGGSLRLSCAASGFTFSSYGMSWVRQVPGKGLEWVSAISGSGGSTYYVDSVKGRFTISRDNFKNTLYLQMNSLRVEDTAVYYCAKDVGYCSTTSCRGDAFDVWGQGTMVTVSS

SEQ ID NO: 115 - DNA, 324 bp, Artificial Sequence
  Synthetic
gacatccagatgacccagtctccatcctccctgtctgcatctgtaggaaacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttacccgctcactttcggccgagggaccaaggtggagatcaaacga

SEQ ID NO: 116 - protein, 108 aa, Artificial Sequence
  Synthetic
DIQMTQSPSSLSASVGNRVTITCRASQGIRNDLGWYQQKPGKAPKRLIYAASSLQSGVPSRFSGSGSGTEFTLTISSLQPEDFATYYCLQHNSYPLTFGRGTKVEIKR

SEQ ID NO: 117 - DNA, 378 bp, Artificial Sequence
  Synthetic
caggtgcagctggtgcagtctggcgctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagtacagtctacatggagctgaggcgcctgagatctgacgacacggccgtttattactgtgcgagagatggcagtcccactatggttactcgctactactcctacggtatggacgtctggggccaagggaccctggtcaccgtctcctca

SEQ ID NO: 118 - protein, 126 aa, Artificial Sequence
  Synthetic
QVQLVQSGAEVKKPGASVKVSCKASGYTFTSYGISWVRQAPGQGLEWMGWISAYNGNTNYAQKLQGRVTMTTDTSTSTVYMELRRLRSDDTAVYYCARDGSPTMVTRYYSYGMDVWGQGTLVTVSS

SEQ ID NO: 119 - DNA, 324 bp, Artificial Sequence
  Synthetic
gacatccagttgacccagtctccatcttccgtgtctgcatctgtaggaaacagagtcaccatcacttgtcgggcgagtcaggatattaacaactggttagtctggtatcaccaaaatccagggaaagcccctaaggtcctgatatatggtgcatcccgattgcaaagtggggtcccatcaaggttcagcggcagtggatctgggacagatttcactctcaccatcagcagcctgcagcctgaagattttgcaacttactattgtcaacaggctaacagtttcccgctcactttcggcggagggaccaaggtggagatcaaacga

SEQ ID NO: 120 - protein, 108 aa, Artificial Sequence
  Synthetic
DIQLTQSPSSVSASVGNRVTITCRASQDINNWLVWYHQNPGKAPKVLIYGASRLQSGVPSRFSGSGSGTDFTLTISSLQPEDFATYYCQQANSFPLTFGGGTKVEIKR

SEQ ID NO: 121 - DNA, 342 bp, Artificial Sequence
  Synthetic
aaggtgcagctggtggagtctgggggaggcttggtacagtttggggggtccctgagactctcctgtgcagcttctggattcacctttagcagctatggtatgaactgggtccgccagactccagggaaggggctcgagtgggtctcggctattggtggaagtggtggtagcacatactacgcagactccgtgaagggccggttcaccatctccagagacaattccaagaacacgctgtatctgcaaatgactagcctgagagccgaggacacggccgtatattactgtgcgaaaggggcctacgatgtctggggccaagggaccacggtcaccgtctcctca

SEQ ID NO: 122 - protein, 114 aa, Artificial Sequence
  Synthetic
KVQLVESGGGLVQFGGSLRLSCAASGFTFSSYGMNWVRQTPGKGLEWVSAIGGSGGSTYYADSVKGRFTISRDNSKNTLYLQMTSLRAEDTAVYYCAKGAYDVWGQGTTVTVSS

SEQ ID NO: 123 - DNA, 324 bp, Artificial Sequence
  Synthetic
gacatccagttgacccagtctccatcctccctgtctgcatctgtaggaaacagagtcaccatcacttgccgggcaagtcagggcattagaaatgatttagcctggtttcagcagaaaccagggaaagcccctaagcccctgatctatgctgcatccagtttgcaaagtggggtcccatcaaggttcagcggcagtggatctgggacagaattcactctcacaatcagcagcctgcagcctgaagattttgcaacttattactgcctacagcataatagttacccgtggactttcggccaagggaccaaggtggaaatcaaacga

SEQ ID NO: 124 - protein, 108 aa, Artificial Sequence
  Synthetic
DIQLTQSPSSLSASVGNRVTITCRASQGIRNDLAWFQQKPGKAPKPLIYAASSLQSGVPSRFSGSGSGTEFTLTISSLQPEDFATYYCLQHNSYPWTFGQGTKVEIKR

SEQ ID NO: 125 - DNA, 342 bp, Artificial Sequence
  Synthetic
caggtgcagctggtggagtctgggggaggcttggtacagtttggggggtccctgagactctcctgtgcagcttctggattcacctttagcagctatggtatgaactgggtccgccagactccagggaaggggctcgagtgggtctcggctattggtggaagtggtggtagcacatactacgcagactccgtgaagggccggttcaccatctccagagacaattccaagaacacgctgtatctgcaaatgactagcctgagagccgaggacacggccgtatattactgtgcgaaaggggcctacgatgtctggggccaagggaccacggtcaccgtctcctca

SEQ ID NO: 126 - protein, 114 aa, Artificial Sequence
  Synthetic
QVQLVESGGGLVQFGGSLRLSCAASGFTFSSYGMNWVRQTPGKGLEWVSAIGGSGGSTYYADSVKGRFTISRDNSKNTLYLQMTSLRAEDTAVYYCAKGAYDVWGQGTTVTVSS

SEQ ID NO: 127 - DNA, 324 bp, Artificial Sequence
  Synthetic
gacatccagttgacccagtctccatccttcctgtctgcatctgtaggaaacagagtcaccatcacttgctgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagcttaatagttacccattcactttcggccctgggaccaaggtggagatcaaacga

SEQ ID NO: 128 - protein, 108 aa, Artificial Sequence
  Synthetic
DIQLTQSPSFLSASVGNRVTITCWASQGISSYLAWYQQKPGKAPKLLIYAASTLQSGVPSRFSGSGSGTEFTLTISSLQPEDFATYYCQQLNSYPFTFGPGTKVEIKR

SEQ ID NO: 129 - DNA, 342 bp, Artificial Sequence
  Synthetic
gaggtgcagctggtggagtctgggggaggcttggtacagtttggggggtccctgagactctcctgtgcagcttctggattcacctttagcagctatggtatgaactgggtccgccagactccagggaaggggctcgagtgggtctcggctattggtggaagtggtggtagcacatactacgcagactccgtgaagggccggttcaccatctccagagacaattccaagaacacgctgtatctgcaaatgactagcctgagagccgaggacacggccgtatattactgtgcgaaaggggcctacgatgtctggggccaagggaccacggtcaccgtctcctca

SEQ ID NO: 130 - protein, 114 aa, Artificial Sequence
  Synthetic
EVQLVESGGGLVQFGGSLRLSCAASGFTFSSYGMNWVRQTPGKGLEWVSAIGGSGGSTYYADSVKGRFTISRDNSKNTLYLQMTSLRAEDTAVYYCAKGAYDVWGQGTTVTVSS

SEQ ID NO: 131 - DNA, 321 bp, Artificial Sequence
  Synthetic
gacatccagatgacccagtctccttccaccctgtctgcatctgtaggagacagagtcaccatcacttgccgggccagtcagagtattagtagctggttggcctggtatcagcagaaaccagggaaagcccctaagctcctgatttataaggcgtctagtttaaaaagtggggtcccatcaaggttcagcggcagtggatctgggacagaattcattctcaccatcagcagcctgcagcctgatgattttgcaacttattactgccaacagtataatagttattggacgttcggccaagggaccaaggtggagatcaaacga

SEQ ID NO: 132 - protein, 107 aa, Artificial Sequence
  Synthetic
DIQMTQSPSTLSASVGDRVTITCRASQSISSWLAWYQQKPGKAPKLLIYKASSLKSGVPSRFSGSGSGTEFILTISSLQPDDFATYYCQQYNSYWTFGQGTKVEIKR

SEQ ID NO: 133 - DNA, 342 bp, Artificial Sequence
  Synthetic
caagtgcagctggtggagtctgggggaggcttggtcaagcctggagggtccctgagactctcctgtgcagcctctggattcaccttcagtgactactacataagctggatccggcaggctccagggaaggggctggagtgggtttcatacattagtagtagtggtagtaccagatactacgcagactctgtgaagggccgattcaccatctccagggacaacgccaagaactcactgtatctgcaaatgaacagcctgagagccgaggacacggccgtgtattactgtgtgagatccggaatggacgtctggggccaagggaccacggtcaccgtctcctca

SEQ ID NO: 134 - protein, 114 aa, Artificial Sequence
  Synthetic
QVQLVESGGGLVKPGGSLRLSCAASGFTFSDYYISWIRQAPGKGLEWVSYISSSGSTRYYADSVKGRFTISRDNAKNSLYLQMNSLRAEDTAVYYCVRSGMDVWGQGTTVTVSS

SEQ ID NO: 135 - DNA, 324 bp, Artificial Sequence
  Synthetic
gccatccagatgacccagtctccatcctccctgtctgcatctgtaggaaacagagtcaccatcacttgccgggcaagtcagggcattataaatgatttaggctggtataaccagaaaccatggaaagcccctaaacgcctgatctatgctgcatccattttgcaaagtggggtcccatcaaggttcagcggccgtggatgtgggacagaattcagtctcacaatcagcagcctgcagcctgaagattttgcaacttattactgtctacagcataatagttacccgctcactttcggcggagggaccaaggtggaaatcaaacga

SEQ ID NO: 136 - protein, 108 aa, Artificial Sequence
  Synthetic
AIQMTQSPSSLSASVGNRVTITCRASQGIINDLGWYNQKPWKAPKRLIYAASILQSGVPSRFSGRGCGTEFSLTISSLQPEDFATYYCLQHNSYPLTFGGGTKVEIKR

SEQ ID NO: 137 - DNA, 351 bp, Artificial Sequence
  Synthetic
caagtgcagctggtgcagtctgggggagacttggtacagcccggcaggtccctgagactctcctgtgcagcctctggattcacctttgatgtttatgccatgcactgggtccggcaagctccagggaagggcctggagtgggtctcaggtattagttggaatagtggttacattggctatgcggactctgtgaagggccgattcaccatctccagagacaacgccaagaactccctgtatctgcaaatgaacagtctgagagctgaggacacggccttgtattactgtgcaaaagataagggtataggttttgactactggggccagggaaccctggtcaccgtctcctca

SEQ ID NO: 138 - protein, 117 aa, Artificial Sequence
  Synthetic
QVQLVQSGGDLVQPGRSLRLSCAASGFTFDVYAMHWVRQAPGKGLEWVSGISWNSGYIGYADSVKGRFTISRDNAKNSLYLQMNSLRAEDTALYYCAKDKGIGFDYWGQGTLVTVSS

SEQ ID NO: 139 - DNA, 324 bp, Artificial Sequence
  Synthetic
gacatccagttgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttacccttggacgttcggccaagggaccaaggtggagatcaaacga

SEQ ID NO: 140 - protein, 108 aa, Artificial Sequence
  Synthetic
DIQLTQSPSSLSASVGDRVTITCRASQGIRNDLGWYQQKPGKAPKRLIYAASSLQSGVPSRFSGSGSGTEFTLTISSLQPEDFATYYCLQHNSYPWTFGQGTKVEIKR

SEQ ID NO: 141 - DNA, 363 bp, Artificial Sequence
  Synthetic
caggtgcagctggtggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagccccatatagtggctacgattggtactttgactactggggccagggaaccctggtcaccgtctcctca

SEQ ID NO: 142 - protein, 121 aa, Artificial Sequence
  Synthetic
QVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKAPYSGYDWYFDYWGQGTLVTVSS

SEQ ID NO: 143 - DNA, 324 bp, Artificial Sequence
  Synthetic
gacataccgatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtctgcaaagtggggtcccatcaaggttcaccggcagtggatctgggacagaattcactctcaccatcagcagcctgcagcctgaagattttgcaacttattactgtctacaacataatagttacccgttcactttcggccaagggaccaagatggagatcaaacga

SEQ ID NO: 144 - protein, 108 aa, Artificial Sequence
  Synthetic
DIPMTQSPSSLSASVGDRVTITCRASQGIRNDLGWYQQKPGKAPKRLIYAASSLQSGVPSRFTGSGSGTEFTLTISSLQPEDFATYYCLQHNSYPFTFGQGTKMEIKR

SEQ ID NO: 145 - DNA, 363 bp, Artificial Sequence
  Synthetic
caggtgcagctggtggagtctgggggaggcgtggtccagcctgggaggtccctgagactctcctgtgcagcctctggatttatcttcagtaactatggcatgcactgggtccgccaggctccaggcaaggggctggagtgggtggcagttatagcatatgatggaagtagtaaacactatgtagactccgtgaagggccgattcaccatctccagagacaattccaagaacacgctgtatctgcaaatgaacagcctgagagctgaggacacggctgtgtattactgtgcgaagcccatagcagtggcccggtattacggtatggacgtctggggccaagggatcacggtcaccgtctcctca

SEQ ID NO: 146 - protein, 121 aa, Artificial Sequence
  Synthetic
QVQLVESGGGVVQPGRSLRLSCAASGFIFSNYGMHWVRQAPGKGLEWVAVIAYDGSSKHYVDSVKGRFTISRDNSKNTLYLQMNSLRAEDTAVYYCAKPIAVARYYGMDVWGQGITVTVSS

SEQ ID NO: 147 - DNA, 324 bp, Artificial Sequence
  Synthetic
gacatcccaatgacccagtctccatcctccctgtctgcgtctgtaggaaacagagtcaccatcacttgccgggcgagtcagggcattagcaattatttagcctggtatcaccacaaaccagggaaagttcctaagctcctgatctatgctgcatccactttgcaatcaggggtcccatctcggttcagtggcagtggatctgggacagatttcactctcaccatccacagcctgcagcctgaagatgttgcaacttattactgtcaaaagtataacagtgccccattcactttcggcccagggaccaaggtggaaatcaaacga

SEQ ID NO: 148 - protein, 108 aa, Artificial Sequence
  Synthetic
DIPMTQSPSSLSASVGNRVTITCRASQGISNYLAWYHHKPGKVPKLLIYAASTLQSGVPSRFSGSGSGTDFTLTIHSLQPEDVATYYCQKYNSAPFTFGPGTKVEIKR

SEQ ID NO: 149 - DNA, 342 bp, Artificial Sequence
  Synthetic
gaggtgcagctggtggagtctgggggaggcttggtacagtttggggggtccctgagactctcctgtgcagcttctggattcacctttagcagctatggcatgaactgggtccgccagactccagggaaggggctggagtgggtctcagctattggtggaagtggtggtagcacatactacgcagactccgtgaagggccggttcaccatctccagagacaattccaagaacacgctgtatctgcaaatgactagcctgagagccgaggacacggccgtatattactgtgcgaaaggggcctacgatgtctggggccaagggaccacggtcaccgtctcctca

SEQ ID NO: 150 - protein, 114 aa, Artificial Sequence; identical to SEQ ID NO: 130
  Synthetic

SEQ ID NO: 151 - DNA, 324 bp, Artificial Sequence
  Synthetic
gacatccagatgacccagtctccatcttccgtgtctgcatctgtaggaaacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccctccgacgttcggccaagggaccaaggtggagatcaaacga

SEQ ID NO: 152 - protein, 108 aa, Artificial Sequence
  Synthetic
DIQMTQSPSSVSASVGNRVTITCRASQGISSWLAWYQQKPGKAPKLLIYAASSLQSGVPSRFSGSGSGTDFTLTISSLQPEDFATYYCQQANSFPPTFGQGTKVEIKR

SEQ ID NO: 153 - DNA, 363 bp, Artificial Sequence
  Synthetic
gaggtgcagctggtgcagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgacgagatccggttatagcagcacctggtacgttgactactggggccagggaaccctggtcaccgtctcctca

SEQ ID NO: 154 - protein, 121 aa, Artificial Sequence
  Synthetic
EVQLVQSGGGVVQPGRSLRLSCAASGFTFSSYGMHWVRQAPGKGLEWVAVIWYDGSNKYYADSVKGRFTISRDNSKNTLYLQMNSLRAEDTAVYYCATRSGYSSTWYVDYWGQGTLVTVSS

SEQ ID NO: 155 - DNA, 324 bp, Artificial Sequence
  Synthetic
gccatccagatgacccagtctccatcttccctgtctgcatctgtaggaaacagagtcaccatcacttgccgggcgagtcagggtattaacaactggttaggctggtatcagcagaaaccagggaaagcccctaaggtcctgatctatgctgcatccagtttgcaaagtggggtcccatcaaggttcagcggcagtggatctgggacagatttcactctcaccatcagcagcctgcagcctgaagattttgcaacttattattgtcaacaggataacagtttccctctcactttcggccgagggaccaaggtggagatcaaacga

SEQ ID NO: 156 - protein, 108 aa, Artificial Sequence
  Synthetic
AIQMTQSPSSLSASVGNRVTITCRASQGINNWLGWYQQKPGKAPKVLIYAASSLQSGVPSRFSGSGSGTDFTLTISSLQPEDFATYYCQQDNSFPLTFGRGTKVEIKR

SEQ ID NO: 157 - DNA, 342 bp, Artificial Sequence
  Synthetic
caggtgcagctggtggagtctgggggaggcttggtacagtttggggggtccctgaaactctcctgtgcagcttctggattcacctttagcagctatggtatgaactgggtccgccagactccagggaaggggctcgagtgggtctcggctattggtggaagtggtggtagcacatactacgcagactccgtgaagggccggttcaccatctccagagacaattccaagaacacgctgtatctgcaaatgactagcctgagagccgaggacacggccgtatattactgtgcgaaaggggcctacgatgtctggggccaagggaccacggtcaccgtctcctca

SEQ ID NO: 158 - protein, 114 aa, Artificial Sequence
  Synthetic
QVQLVESGGGLVQFGGSLKLSCAASGFTFSSYGMNWVRQTPGKGLEWVSAIGGSGGSTYYADSVKGRFTISRDNSKNTLYLQMTSLRAEDTAVYYCAKGAYDVWGQGTTVTVSS

SEQ ID NO: 159 - DNA, 324 bp, Artificial Sequence
  Synthetic
gacatccagatgacccagtctccatcctccctgtctgcatctgtaggaaacagagtcaccatcacttgccgggcaagtcagggcattagaaatgatttaggctggtatcaccagaaaccagggaaagcccctaagcgcctgatctatgctgcatccactttgcaaagtggggtcccatcaaggttcagcggcagtggatctgggacagaattcactctcaccatcagcagcctgcagcctgaagattttgcaacttattactgtctacagcataatagttaccccttcactttcggccaagggaccaaggtggagatcaaacga

SEQ ID NO: 160 - protein, 108 aa, Artificial Sequence
  Synthetic
DIQMTQSPSSLSASVGNRVTITCRASQGIRNDLGWYHQKPGKAPKRLIYAASTLQSGVPSRFSGSGSGTEFTLTISSLQPEDFATYYCLQHNSYPFTFGQGTKVEIKR

SEQ ID NO: 161 - DNA, 342 bp, Artificial Sequence
  Synthetic
caggtgcagctggtggagtctgggggaggcttggtacagtttggggggtccctgagactctcctgtgcagcttctggattcacctttagcagctatggtatgaactgggtccgccagagtccagggaaggggctcgagtgggtctcggctattggtggaagtggtggtagcacatactacgcagactccgtgaagggccggttcaccatctccagagacaattccaagaacacgctgtatctgcaaatgactagcctgagagccgaggacacggccgtatattactgtgcgaaaggggcctacgatgtctggggccaagggaccacggtcaccgtctcctca

SEQ ID NO: 162 - protein, 114 aa, Artificial Sequence
  Synthetic
QVQLVESGGGLVQFGGSLRLSCAASGFTFSSYGMNWVRQSPGKGLEWVSAIGGSGGSTYYADSVKGRFTISRDNSKNTLYLQMTSLRAEDTAVYYCAKGAYDVWGQGTTVTVSS

SEQ ID NO: 163 - DNA, 324 bp, Artificial Sequence
  Synthetic
gacatccagatgacccagtctccatcctccctgtctgcatctgtcggagacagagtcaccatcacttgccgggcgagtcaggacattaccaattatttagcctggtatcagcagaaaccagggaaagttcctaagctcctgatctatactacatccactttgcaatcaggggtcccatctcgtttcagtggcagtggatctgggacagatttcactctcaccatcaccagcctgcagcctgaagatgttgcgacttatttctgtcaaaaatataacagtgaccctttcactttcggccctgggaccaaggtggaaatcaaacga

SEQ ID NO: 164 - protein, 108 aa, Artificial Sequence
  Synthetic
DIQMTQSPSSLSASVGDRVTITCRASQDITNYLAWYQQKPGKVPKLLIYTTSTLQSGVPSRFSGSGSGTDFTLTITSLQPEDVATYFCQKYNSDPFTFGPGTKVEIKR

SEQ ID NO: 165 - DNA, 342 bp, Artificial Sequence
  Synthetic
caggtgcagctggtggagtctgggggaggcttggtacagtttggggggtccctgaaactctcctgtgcagcttctggattcacctttagcagctatggtatgaactgggtccgccagactccagggaaggggctcgagtgggtctcggctattggtggaagtggtggtagcacatactacgcagactccgtgaagggccggttcaccatctccagagacaattccaagaacacgctgtatctgcaaatgactagcctgagagccgaggacacggccgtatattactgtgcgaaaggggcctacgatgtctgggcccaagggaccacggtcaccgtctcctca

SEQ ID NO: 166 - protein, 114 aa, Artificial Sequence
  Synthetic
QVQLVESGGGLVQFGGSLKLSCAASGFTFSSYGMNWVRQTPGKGLEWVSAIGGSGGSTYYADSVKGRFTISRDNSKNTLYLQMTSLRAEDTAVYYCAKGAYDVWAQGTTVTVSS

SEQ ID NO: 167 - DNA, 324 bp, Artificial Sequence
  Synthetic
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataataattacccgtggacgttcggccaagggaccaaggtggaaatcaaacga

SEQ ID NO: 168 - protein, 108 aa, Artificial Sequence
  Synthetic
DIQMTQSPSSLSASVGDRVTITCRASQGIRNDLGWYQQKPGKAPKRLIYAASSLQSGVPSRFSGSGSGTEFTLTISSLQPEDFATYYCLQHNNYPWTFGQGTKVEIKR

SEQ ID NO: 169 - DNA, 363 bp, Artificial Sequence; identical to SEQ ID NO: 145
  Synthetic

SEQ ID NO: 170 - protein, 121 aa, Artificial Sequence; identical to SEQ ID NO: 146
  Synthetic

SEQ ID NO: 171 - DNA, 324 bp, Artificial Sequence
  Synthetic
gacatccagttgacccagtctccatcctccctgtctgcatctgtaggaaacagagtcaccatcacttgccgggcgagtcagggcattagcaattatttagcctggtatcagcagaaaccagggaaagcccctaagctcctgatctatgctgcatccactttgcaatctggggtcccatctcggttcagcggcagtggatctgggacagatttcactctcaccatcagcagcctgcagcctgaagatgttgcaacttattactgtcaaaagtataacagtgccccgctcactttcggcggagggaccaaggtggaaatcaaacga

SEQ ID NO: 172 - protein, 108 aa, Artificial Sequence
  Synthetic
DIQLTQSPSSLSASVGNRVTITCRASQGISNYLAWYQQKPGKAPKLLIYAASTLQSGVPSRFSGSGSGTDFTLTISSLQPEDVATYYCQKYNSAPLTFGGGTKVEIKR

SEQ ID NO: 173 - DNA, 342 bp, Artificial Sequence; identical to SEQ ID NO: 125
  Synthetic

SEQ ID NO: 174 - protein, 114 aa, Artificial Sequence; identical to SEQ ID NO: 126
  Synthetic

SEQ ID NO: 175 - DNA, 339 bp, Artificial Sequence
  Synthetic
gacatcgtgatgacccaaactccactctcctcacctgtcacccttggacagccggcctccatctcctgcaggtctagtcaaagcctcgtacacagtgatggaaacacctacttgagttggcttcagcagaggccaggccagcctccaagactcctaatttataagatttctaaccggttctctggggtcccagacagattcagtggcagtggggcagggacagatttcacactgaaaatcagcagggtggaagctgaggatgtcggggtttattactgcatgcaagctacacaatttcctcagacgttcggccaagggaccaaggtggagatcaaacga

SEQ ID NO: 176 - protein, 113 aa, Artificial Sequence
  Synthetic
DIVMTQTPLSSPVTLGQPASISCRSSQSLVHSDGNTYLSWLQQRPGQPPRLLIYKISNRFSGVPDRFSGSGAGTDFTLKISRVEAEDVGVYYCMQATQFPQTFGQGTKVEIKR

SEQ ID NO: 177 - DNA, 360 bp, Artificial Sequence
  Synthetic
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgtagactccgttaagggccgattcaccacctccagagacaattccaagaacacgctgtatctgcaaatgaacagcctgagagccgaggacacggctatgtattactgtgtgagaggaagaggcacacaggaccccctctttgacaactggggccagggaaccctggtcaccgtctcctca

SEQ ID NO: 178 - protein, 120 aa, Artificial Sequence
  Synthetic
QVQLVESGGGVVQPGRSLRLSCAASGFTFSSYGMHWVRQAPGKGLEWVAVIWYDGSNKYYVDSVKGRFTTSRDNSKNTLYLQMNSLRAEDTAMYYCVRGRGTQDPLFDNWGQGTLVTVSS

SEQ ID NO: 179 - DNA, 324 bp, Artificial Sequence
  Synthetic
gacatccagttgacccagtctccatcttccgtgtctgcatctgtaggaaacagagtcaccatcacttgtcgggcgagtcagggcattagcagctggttagcctggtatcagcagaaaccagggaaagcccctaacctcctgatctatgctatatccagtttgcgcagtggggtcccatcaaggttcagcggcagtggatctgggacagatttcactctcaccatcagcagcctgcagcctgaagattttgcaacttactattgtcaacaggctaaaagtttcccgtacacttttggccaggggaccaaggtggagatcaaacga

SEQ ID NO: 180 - protein, 108 aa, Artificial Sequence
  Synthetic
DIQLTQSPSSVSASVGNRVTITCRASQGISSWLAWYQQKPGKAPNLLIYAISSLRSGVPSRFSGSGSGTDFTLTISSLQPEDFATYYCQQAKSFPYTFGQGTKVEIKR

SEQ ID NO: 181 - DNA, 342 bp, Artificial Sequence; identical to SEQ ID NO: 125
  Synthetic

SEQ ID NO: 182 - protein, 114 aa, Artificial Sequence; identical to SEQ ID NO: 126
  Synthetic

SEQ ID NO: 183 - DNA, 324 bp, Artificial Sequence
  Synthetic
gacatccagatgacccagtctccatcctcattctctgcatctacaggaaacagagtcaccatcacttgtcgggcgagtcagggcattagcagttatttagcctggtatcaccaaaaaccacggaaagcccctaagctcctgatctatgctgcatccactttgcaaagtggggtcccatcaaggttcagcggcagtggatctgggacagatttcactctcaccatcagcagcctgcagtctgaagattttgcaacttattactgtcaacagtattatagttacccgtggacgttcggccaagggaccaaggtggagatcaaacga

SEQ ID NO: 184 - protein, 108 aa, Artificial Sequence
  Synthetic
DIQMTQSPSSFSASTGNRVTITCRASQGISSYLAWYHQKPRKAPKLLIYAASTLQSGVPSRFSGSGSGTDFTLTISSLQSEDFATYYCQQYYSYPWTFGQGTKVEIKR

SEQ ID NO: 185 - DNA, 396 bp, Artificial Sequence
  Synthetic
caggtgcagctggtgcagtctgggggaggcgtggtccagcctgggaggtccctgagactctcctgtgcagcctctggattcaccttcagtagctatggcatgcactgggtccgccaggctccaggcaaggggctggagtgggtggcatttatatcatatgatggaagtaataaatactatgcagactccgtgaagggccgactcaccatctccagggacaattccaagaacatgctgtatctgcaaatgaacagcctgagagctgaggacacggctgtgtattactgtgcgaaagggggtgtagtagtaccaggtcctacacggtataactggaaccactactactactatggtatggacgtctggggccaagggaccacggtcaccgtctcctca

SEQ ID NO: 186 - protein, 132 aa, Artificial Sequence
  Synthetic
QVQLVQSGGGVVQPGRSLRLSCAASGFTFSSYGMHWVRQAPGKGLEWVAFISYDGSNKYYADSVKGRLTISRDNSKNMLYLQMNSLRAEDTAVYYCAKGGVVVPGPTRYNWNHYYYYGMDVWGQGTTVTVSS

SEQ ID NO: 187 - DNA, 324 bp, Artificial Sequence
  Synthetic
gacatccagttgacccagtctccatccttcctgtctgcatctgtaggaaacagagtcaccatcacttgctgggccagtcaggacattagcagttatttagtctggtatcagcaaaaaccagggaaagcccctaagctcctgatctacgctgcatccactttgcaaagtggggtcccatcaaggttcagcggcagtggatctgggacagaattcactctcacaatcagcagcctgcagcctgaagattttgcaacttattactgtcaacagcttaatacttgcccattcactttcggccctgggaccaaggtggagatcaaacga

SEQ ID NO: 188 - protein, 108 aa, Artificial Sequence
  Synthetic
DIQLTQSPSFLSASVGNRVTITCWASQDISSYLVWYQQKPGKAPKLLIYAASTLQSGVPSRFSGSGSGTEFTLTISSLQPEDFATYYCQQLNTCPFTFGPGTKVEIKR

SEQ ID NO: 189 - DNA, 354 bp, Artificial Sequence
  Synthetic
caggtgcagctggtgcagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtgataaaaagtatgcagactccgtgaagggccgaatcaccatctccagagacaattccaagaatacgctgtatctgcaaatgaacagcctgagagctgaggacacggctgtgtattactgtgcgaaaggggggagtgggagctcctttgactactggggccagggaatcctggtcaccgtctcctca

SEQ ID NO: 190 - protein, 118 aa, Artificial Sequence
  Synthetic
QVQLVQSGGGVVQPGRSLRLSCAASGFTFSSYGMHWVRQAPGKGLEWVAVISYDGSDKKYADSVKGRITISRDNSKNTLYLQMNSLRAEDTAVYYCAKGGSGSSFDYWGQGILVTVSS

SEQ ID NO: 191 - DNA, 327 bp, Artificial Sequence
  Synthetic
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcaccggcagtggatctgggacagaattcactctcaccatcagcagcctgcagcctgatgattttgcaacttattactgccaacagtataatagttattctccgtggacgttcggccaagggaccaaggtggagatcaaacga

SEQ ID NO: 192 - protein, 109 aa, Artificial Sequence
  Synthetic
DIQMTQSPSTLSASVGDRVTITCRASQSISSWLAWYQQKPGKAPKLLIYKASSLESGVPSRFTGSGSGTEFTLTISSLQPDDFATYYCQQYNSYSPWTFGQGTKVEIKR

SEQ ID NO: 193 - DNA, 354 bp, Artificial Sequence
  Synthetic
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagtcatatcgtatgatggaaatgataaaaaatatgcagactccgtgaagggccgattcaccatctccagagacaattccaagagcacgctgtatctgcaaatgaacaccctgagagatgaggacacggctattttttactgtgcgaaagggggcaggggatttgcttttgatatctggggccaagggacaatggtcaccgtctcttca

SEQ ID NO: 194 - protein, 118 aa, Artificial Sequence
  Synthetic
QVQLVESGGGVVQPGRSLRLSCAASGFTFSSYGMHWVRQAPGKGLEWVAVISYDGNDKKYADSVKGRFTISRDNSKSTLYLQMNTLRDEDTAIFYCAKGGRGFAFDIWGQGTMVTVSS

SEQ ID NO: 195 - DNA, 324 bp, Artificial Sequence
  Synthetic
gacatcccgatgacccagtctccatcctcattctctgcatctacaggaaacagagtcaccatcacttgtcgggcgagtcagggcattagaagttatttagcctggtatcaccaaaaaccagggaaagcccctaagctcctgatctatgctgcatccactttgcaaagtggggtcccatcaaggttcaccggcagtggatctgggacagatttcactctcaccatcagctgcctgcagtctgaagattttgcaacttattactgtcaacagtattatagttacccgttcacttttggccaggggaccaaggtggagatcaaacga

SEQ ID NO: 196 - protein, 108 aa, Artificial Sequence
  Synthetic
DIPMTQSPSSFSASTGNRVTITCRASQGIRSYLAWYHQKPGKAPKLLIYAASTLQSGVPSRFTGSGSGTDFTLTISCLQSEDFATYYCQQYYSYPFTFGQGTKVEIKR

SEQ ID NO: 197 - DNA, 351 bp, Artificial Sequence
  Synthetic
gaggtgcagctggtgcagtctgggggaggcgtggtccagcctgggaggtccctgagactctcctgtgcagcgtctggattcaccttcagtagctatggcatgcactgggtccgccaggctccaggcaaggggctggagtgggtggtagttatatggtatgatggaagtaataaatactatggagactccgtgaagggccgattcaccatctccagagacaattccaagaacacgctgtatctgcaaatgaacagcctgagagccgaggacacggctgtttattactgtgcgagaggaaactactttgcttttgatatttggggccaagggacaatggtcaccgtctcctca

SEQ ID NO: 198 - protein, 117 aa, Artificial Sequence
  Synthetic
EVQLVQSGGGVVQPGRSLRLSCAASGFTFSSYGMHWVRQAPGKGLEWVVVIWYDGSNKYYGDSVKGRFTISRDNSKNTLYLQMNSLRAEDTAVYYCARGNYFAFDIWGQGTMVTVSS

SEQ ID NO: 199 - DNA, 324 bp, Artificial Sequence
  Synthetic
gacataccgatgacccagtctccatccttcctgtctgcgtctgtaggaagcagagtcaccatcacttgctgggccagtcagggcattagcagttatttagtctggtatcagcaaaaaccagggaaagcccctaagctcctgatgtatgaggcatccaatccgcaaagtggggtcccatcaaggttcaccggcagtggattagggacagaattcattgtcccaatcagcagcctgcagccggaggatttttcaagttattactgtcagcagattaataaataccctctcactttcggcggagggaccaagatggagatcaaacga

SEQ ID NO: 200 - protein, 108 aa, Artificial Sequence
  Synthetic
DIPMTQSPSFLSASVGSRVTITCWASQGISSYLVWYQQKPGKAPKLLMYEASNPQSGVPSRFTGSGLGTEFIVPISSLQPEDFSSYYCQQINKYPLTFGGGTKMEIKR

SEQ ID NO: 201 - DNA, 396 bp, Artificial Sequence
  Synthetic
gaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcatttatttcatatgatggaagtaataaattctatgcagactccgtgaagggccgactcaccatctccagggacaattccaagaacatgctgtatctgcaaatgaacagcctgagagctgaggacacggctgtgtattactgtgcgaaagggggtgtagtaataccaggtcctacacggtataactggaaccactactactactatggtatggacgtctggggccaagggaccacggtcaccgtctcctca

SEQ ID NO: 202 - protein, 132 aa, Artificial Sequence
  Synthetic
EVQLVESGGGVVQPGRSLRLSCAASGFTFSSYGMHWVRQAPGKGLEWVAFISYDGSNKFYADSVKGRLTISRDNSKNMLYLQMNSLRAEDTAVYYCAKGGVVIPGPTRYNWNHYYYYGMDVWGQGTTVTVSS

SEQ ID NO: 203 - DNA, 324 bp, Artificial Sequence
  Synthetic
gacataccgttgacccagtctccatcctccctgtctgcatctgtaggagacagagtcaccatcacttgccgggcgagtcagggcattagcaattatttagcctggtatcagcagaaaccagggaaagttcctaagctcctgatctatgctgcatccactttgcaatcaggggtcccatctcggttcagtggcagtggatctgggacagatttcactctcaccatccacagcctgcagcctgaagatgttgcaacttattactgtcaaaagtataacagtgccccttggacgttcggccaagggaccaaattggagatcaaacga

SEQ ID NO: 204 - protein, 108 aa, Artificial Sequence
  Synthetic
DIPLTQSPSSLSASVGDRVTITCRASQGISNYLAWYQQKPGKVPKLLIYAASTLQSGVPSRFSGSGSGTDFTLTIHSLQPEDVATYYCQKYNSAPWTFGQGTKLEIKR

SEQ ID NO: 205 - DNA, 354 bp, Artificial Sequence
  Synthetic
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtgacagttatatcatatgatggaagtgataaatactatgcagactccgtgaagggccgattcaccatctccagagacaattccaagaacacgctgtatctgcaaatgaacagcctgagagctgaggacacggctatgtattactgtgtgaaagggggcagtggctggtcctttgactactggggccagggaaccctggtcaccgtctcctca

SEQ ID NO: 206 - protein, 118 aa, Artificial Sequence
  Synthetic
QVQLVESGGGVVQPGRSLRLSCAASGFTFSSYGMHWVRQAPGKGLEWVTVISYDGSDKYYADSVKGRFTISRDNSKNTLYLQMNSLRAEDTAMYYCVKGGSGWSFDYWGQGTLVTVSS

SEQ ID NO: 207 - DNA, 324 bp, Artificial Sequence
  Synthetic
gccatccagatgacccagtctccatcctccctgtctgcatctgtaggaaacagagtcaccatcacttgccgggcaagtcagggcattagaaatgatttaggctggtatcagcagaaaccagggaaagcccctaagctcctgatctatgctgcatccagtttacaaagtggggtcccatcaaggttcagcggcagtggatctggcacagatttcactctcaccatcagcagcctgcagcctgaagattttgcaacttattactgtctacaagattacaattaccctcacacttttggccaggggaccaaggtggagatcaaacga

SEQ ID NO: 208 - protein, 108 aa, Artificial Sequence
  Synthetic
AIQMTQSPSSLSASVGNRVTITCRASQGIRNDLGWYQQKPGKAPKLLIYAASSLQSGVPSRFSGSGSGTDFTLTISSLQPEDFATYYCLQDYNYPHTFGQGTKVEIKR

SEQ ID NO: 209 - DNA, 354 bp, Artificial Sequence
  Synthetic
caggtgcagctggtggagtctgggggaggcgtggtccaacctgggaggtccctgagactctcctgtgtagcctctggattcatcttcagtgactatggcatgcactgggtccgccaggctccaggcaaggggctggagtgggtggcagttatatcatatgatggaagtgataaaaactatgtagactccgtgaagggccgcttcaccatctccagagacaattccaagaaaacgcagtatctgcaaatgaacagcctgagagctgaggacacggctgtctattattgtgcgaaagggggcagtggctggtcctttgattactggggcccgggaaccctggtcaccgtctcctca

SEQ ID NO: 210 - protein, 118 aa, Artificial Sequence
  Synthetic
QVQLVESGGGVVQPGRSLRLSCVASGFIFSDYGMHWVRQAPGKGLEWVAVISYDGSDKNYVDSVKGRFTISRDNSKKTQYLQMNSLRAEDTAVYYCAKGGSGWSFDYWGPGTLVTVSS

SEQ ID NO: 211 - DNA, 324 bp, Artificial Sequence
  Synthetic
gacatccagatgacccagtctccatccttcctgtctgcatctgtaggaaacagagtcaccatcacttgctgggccagtcagggcattagaaattatttagcctggtatcaccaaaaaccagggaaagcccctaagctcctgatctatgctgcatccactttacaaagtggggtcccatcaaggttcagcggcagtggatctgggacagatttcactctcaccatcagcagcctgcagcctgaagattttgcaacttattactgtcaacaacttaatagttaccctctcactttcggcggagggaccaaggtggagatcaaacga

SEQ ID NO: 212 - protein, 108 aa, Artificial Sequence
  Synthetic
DIQMTQSPSFLSASVGNRVTITCWASQGIRNYLAWYHQKPGKAPKLLIYAASTLQSGVPSRFSGSGSGTDFTLTISSLQPEDFATYYCQQLNSYPLTFGGGTKVEIKR

SEQ ID NO: 213 - DNA, 354 bp, Artificial Sequence
  Synthetic
caggtgcagctggtggagtctgggggaggcgtggtccagcctgggaggtccctgagactctcctgtgtagcctctggattcaccttcagtgactatggcatgcactgggtccgccaggctccaggcaaggggctggagtgggtggcagttatatcatatgatggaaataataaaaactatgcagactccgtgatgggccgcttcaccatctccagagacaattccaagaaaacgcagtatctgcaaatgaacagcctgagagctgaggacacggctgtctattactgtgcgaaagggggcagtggctggtcctttgactactggggcccgggaaccctggtcaccgtctcctca

SEQ ID NO: 214 - protein, 118 aa, Artificial Sequence
  Synthetic
QVQLVESGGGVVQPGRSLRLSCVASGFTFSDYGMHWVRQAPGKGLEWVAVISYDGNNKNYADSVMGRFTISRDNSKKTQYLQMNSLRAEDTAVYYCAKGGSGWSFDYWGPGTLVTVSS

SEQ ID NO: 215 - DNA, 339 bp, Artificial Sequence
  Synthetic
gacgtcgtgatgacccagactccactctcctctcctgtcacccttggacagccggcctccatctcctgcaggtctagtcaaggcctcgtacgcagtgatggaaacacctacttgagttggcttcagcagaggccaggccagcctccaagactcctaatttataagatttctaaccgattctctggggtcccagacagattcagtggcagtggggcagggacaactttcacacttaaaatcaacagggtggaagttgaggatgtcggggtttattactgcctgcaagctacacaatttcctttcactttcggccatgggacaaaggtggagatcaaacga

SEQ ID NO: 216 - protein, 113 aa, Artificial Sequence
  Synthetic
DVVMTQTPLSSPVTLGQPASISCRSSQGLVRSDGNTYLSWLQQRPGQPPRLLIYKISNRFSGVPDRFSGSGAGTTFTLKINRVEVEDVGVYYCLQATQFPFTFGHGTKVEIKR

SEQ ID NO: 217 - DNA, 354 bp, Artificial Sequence
  Synthetic
gaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtgacagttatatcatatgatggaagtgataaatactatgcagactccgtgaagggccgattcaccatctccagagacaattccaagaacacgctgtatctgcaaatgaacagcctgagagctgaggacacggctatgtattactgtgtgaaagggggcagtggctggtcctttgactactggggccagggaaccctggtcactgtctcctca

SEQ ID NO: 218 - protein, 118 aa, Artificial Sequence
  Synthetic
EVQLVESGGGVVQPGRSLRLSCAASGFTFSSYGMHWVRQAPGKGLEWVTVISYDGSDKYYADSVKGRFTISRDNSKNTLYLQMNSLRAEDTAMYYCVKGGSGWSFDYWGQGTLVTVSS

SEQ ID NO: 219 - DNA, 324 bp, Artificial Sequence
  Synthetic
gacatccagttgacccagtctccatcctcactgtctgcatctgtaggaaacagagtcaccatcacttgtcgggcgagtcagggcattagcaattatttagcctggtttcagcagaaaccagggaaagcccctaagtccctgatctatgctgcatccagtttgcaaagtggggtcccatcaaagttcagcggcagtggatctgggacagatttcactctcaccatcagcagcctgcagcctgaagattttgcaacttattactgccaacagtataatagttacccgctcactttcggcggagggaccaagctggaaatcaaacga

SEQ ID NO: 220 - protein, 108 aa, Artificial Sequence
  Synthetic
DIQLTQSPSSLSASVGNRVTITCRASQGISNYLAWFQQKPGKAPKSLIYAASSLQSGVPSKFSGSGSGTDFTLTISSLQPEDFATYYCQQYNSYPLTFGGGTKLEIKR

SEQ ID NO: 221 - DNA, 372 bp, Artificial Sequence
  Synthetic
gaggtgcagctggtgcagtctgggggaggcttggtaaagcctggggggtcccttagactctcctgtacagcctctggattcactttcagtaacgcctggatgagctgggtccgccaggctccagggaaggggctggagtgggttggccgtattaaaagcaaacctgctggtgggacaacagactacgctgcacccgtgaaagacagattctccatctcaagagatgattcaaaaaccacgctgtatctgcgaatgaacagcctgaaaaccgaggacacagccgtgtattactgtaccacaagtataacaactcgaagggggacgtactactttgactactggggccagggaaccctggtcaccgtctcctca

SEQ ID NO: 222 - protein, 124 aa, Artificial Sequence
  Synthetic
EVQLVQSGGGLVKPGGSLRLSCTASGFTFSNAWMSWVRQAPGKGLEWVGRIKSKPAGGTTDYAAPVKDRFSISRDDSKTTLYLRMNSLKTEDTAVYYCTTSITTRRGTYYFDYWGQGTLVTVSS

SEQ ID NO: 223 - DNA, 324 bp, Artificial Sequence
  Synthetic
gacatccagatgacccagtctccttcctccttgtctgcatctacaggaaacagagtcaccatcacttgccgggccagtcagggtattagcagctgtttggcctggtatcaccaaaaaccagggaaagcccctaagctcctgatctatgctgcatccactttacaaagtggggtcccatcaaggttcagcggcagtggatctgggacagatttcactctcaccatcagctgcctgcagtctgaagattttgcaacttattactgccaacagtattatagttaccctctcactttcggcggagggaccaaggtggaaatcaaacga

SEQ ID NO: 224 - protein, 108 aa, Artificial Sequence
  Synthetic
DIQMTQSPSSLSASTGNRVTITCRASQGISSCLAWYHQKPGKAPKLLIYAASTLQSGVPSRFSGSGSGTDFTLTISCLQSEDFATYYCQQYYSYPLTFGGGTKVEIKR

SEQ ID NO: 225 - DNA, 354 bp, Artificial Sequence
  Synthetic
gaggtgcagctggtgcagtctgggggaggcgtggtccagcctgggaggtccctgagactctcctgtgcagcctctggattcaccttcaataattatggcatgcactgggtccgccaggctccaggcaaggggctggagtggttggcagttatatcatatgatggcaatgataaacactatgttgactccgtgaagggccgattcaccacttccagggacaattccaagaacacgctgtatctgcaaatgaacagcctgagagttgaggacacggctgtgttttactgtgtgagagggggcagtggctggtcctttgactcctggggccagggaaccctggtcaccgtctcctca

SEQ ID NO: 226 - protein, 118 aa, Artificial Sequence
  Synthetic
EVQLVQSGGGVVQPGRSLRLSCAASGFTFNNYGMHWVRQAPGKGLEWLAVISYDGNDKHYVDSVKGRFTTSRDNSKNTLYLQMNSLRVEDTAVFYCVRGGSGWSFDSWGQGTLVTVSS

SEQ ID NO: 227 - DNA, 339 bp, Artificial Sequence
  Synthetic
gatattgtgatgacccagactccactctcctcacctgtctcccttggacacccggcctccatctcctgcaggtctagtcaaagcctcaaaaaaagtgatggaaacacctacttgagttggcttcagcagaggccaggccagcctccaagactcctaatttataacatttctaaccggttctctggggtcccagacagattcagtggcagtggggcagggacagatttcacactgaaaatcaccagggtggaagctgaagatgtcgggttttattactgcatgcaaactactcaatttcctttcactttcggccctgggaccaaggtggagatcaaacga

SEQ ID NO: 228 - protein, 113 aa, Artificial Sequence
  Synthetic
DIVMTQTPLSSPVSLGHPASISCRSSQSLKKSDGNTYLSWLQQRPGQPPRLLIYNISNRFSGVPDRFSGSGAGTDFTLKITRVEAEDVGFYYCMQTTQFPFTFGPGTKVEIKR

SEQ ID NO: 229 - DNA, 354 bp, Artificial Sequence
  Synthetic
caggtgcagctggtggagtctgggggaggcgtggtccagcctgggaggtccctgagactctcctgtgcagcctctggattcaccttcaataattatggcatgcactgggtccgccaggctccaggcaaggggctggagtggttggcagttatatcatatgatggcaatgataaacactatgttgactccgtgaagggccgattcaccacttccagagacaattccaagaacacgctgtatctgcaaatgaacagcctgagagttgaggacacggctgtgttttactgtgtgagagggggcagtggctggtcctttgactcctggggccagggaaccctggtcaccgtctcctca

SEQ ID NO: 230 - protein, 118 aa, Artificial Sequence
  Synthetic
QVQLVESGGGVVQPGRSLRLSCAASGFTFNNYGMHWVRQAPGKGLEWLAVISYDGNDKHYVDSVKGRFTTSRDNSKNTLYLQMNSLRVEDTAVFYCVRGGSGWSFDSWGQGTLVTVSS

SEQ ID NO: 231 - DNA, 324 bp, Artificial Sequence
  Synthetic
gcacatccgatgacccagtctccatccttcctgtctgcatctgtaggaaacagagtcaccatcacttgctgggccagtcagggcattagcagttatttagcctggtatcagcaaaaaccagggaaagcccctaagctcctgatctatgctgcatccactttgcaaagtggggtcccatcaaggttcaccggcagtggatctgggacagaattcactctcacaatcagcagcctgcagcctgaagattttgcaacttattactgtcaacagcttaatagttaccctcggacgttcggccaagggaccaagctggatatcaaacga

SEQ ID NO: 232 - protein, 108 aa, Artificial Sequence
  Synthetic
AHPMTQSPSFLSASVGNRVTITCWASQGISSYLAWYQQKPGKAPKLLIYAASTLQSGVPSRFTGSGSGTEFTLTISSLQPEDFATYYCQQLNSYPRTFGQGTKLDIKR

SEQ ID NO: 233 - DNA, 363 bp, Artificial Sequence
  Synthetic
gaggtgcagctggtgcagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgctggaattaataaatactatgcagactccgtgaagggccgattcaccatttccagagacgattccaagaacacgctgtttctgcaaatgaacagcctgagaactgaggacacggctgtgtattactgtgcgaaaagggatagtgggatctcccatgatccttttgatatttggggccaagggacaatggtcaccgtctcttca

SEQ ID NO: 234 - protein, 121 aa, Artificial Sequence
  Synthetic
EVQLVQSGGGVVQPGRSLRLSCAASGFTFSSYGMHWVRQAPGKGLEWVAVISYAGINKYYADSVKGRFTISRDDSKNTLFLQMNSLRTEDTAVYYCAKRDSGISHDPFDIWGQGTMVTVSS

SEQ ID NO: 235 - DNA, 324 bp, Artificial Sequence
  Synthetic
gacatccagatgacccagtctccatccttcctgtctgcatctgtaggagacagagtcaccatcacttgctgggccagtcagggcattagcagttatttagcctggtatcagcaaaaaccagggaaagcccctaagctcctgatctatgctacatccactttgcaaagtggggtcccatcaaggttcagcggcagtggatctgggacagaattcactctcacaatcagcagcctgcagcctgaagattttgcaacttattactgtcaacagcttaatagttacccgctcactttcggcggagggaccaaggtggaaatcaaacga

SEQ ID NO: 236 - protein, 108 aa, Artificial Sequence
  Synthetic
DIQMTQSPSFLSASVGDRVTITCWASQGISSYLAWYQQKPGKAPKLLIYATSTLQSGVPSRFSGSGSGTEFTLTISSLQPEDFATYYCQQLNSYPLTFGGGTKVEIKR

SEQ ID NO: 237 - DNA, 357 bp, Artificial Sequence
  Synthetic
caagtgcagctggtgcagtctgggggaggcgtggtccagcctgggaggtccctgagactctcctgtgcagcctctggattcaccttcagtagctatggcatgcactgggtccgccaggctccaggcaaggggctggagtgggtggcagttatatcatatcaggaaagtaataaatactatgtagactccgtgaagggccgattcaccatctccagagacaattccaagaacacgctatatctgcaaatgaacagcctgagcgctgaggacacggctgtgtattactgtgcgcaaagtcgtggatacagctatggtctaggttactggggccagggaaccctggtcaccgtctcctca

SEQ ID NO: 238 - protein, 119 aa, Artificial Sequence
  Synthetic
QVQLVQSGGGVVQPGRSLRLSCAASGFTFSSYGMHWVRQAPGKGLEWVAVISYQESNKYYVDSVKGRFTISRDNSKNTLYLQMNSLSAEDTAVYYCAQSRGYSYGLGYWGQGTLVTVSS

SEQ ID NO: 239 - DNA, 342 bp, Artificial Sequence
  Synthetic
gacatccagttgacccagtctccagactccctggctgtgtctctgggcgagagggccaccatcaactgcaagtccagccagagtgttttatacagctccaacaataagaactacttaacttggtaccagcagaaaccaggacagcctcctaatctgctcatttactggacatctacccgggaatccggggtccctgaccgattcagtggcagcgggtctgggacagatttcactctcaccatcagcagcctgcaggctgaagatgtggcagtttattactgtcagcaatattatagtattccgtacacttttggccaggggaccaaggtggaaatcaaacga

SEQ ID NO: 240 - protein, 114 aa, Artificial Sequence
  Synthetic
DIQLTQSPDSLAVSLGERATINCKSSQSVLYSSNNKNYLTWYQQKPGQPPNLLIYWTSTRESGVPDRFSGSGSGTDFTLTISSLQAEDVAVYYCQQYYSIPYTFGQGTKVEIKR

SEQ ID NO: 241 - DNA, 357 bp, Artificial Sequence
  Synthetic
caggtgcagctggtgcagtctgggggaggcgtggtccagcctgggaggtccctgagactctcctgtgaagcctctggattcaccttcagtagctatggcatgcactgggtccgccaggctccaggcaaggggctggagtgggtggcagttatatcatatgatggaagtaataaacactatgcagactccgtgaagggccgattcaccatctccagagacaattccaagaacacgctgtatgtgcaaatgaacagcctgagagctgaggacacggctgtgtattactgtgcgcaaagtcgtggatacagctatggtctaggctactggggccagggaaccctggtcaccgtctcctca

SEQ ID NO: 242 - protein, 119 aa, Artificial Sequence
  Synthetic
QVQLVQSGGGVVQPGRSLRLSCEASGFTFSSYGMHWVRQAPGKGLEWVAVISYDGSNKHYADSVKGRFTISRDNSKNTLYVQMNSLRAEDTAVYYCAQSRGYSYGLGYWGQGTLVTVSS

SEQ ID NO: 243 - DNA, 342 bp, Artificial Sequence
  Synthetic
gccatccagatgacccagtctccagactccctggctgtgtctctgggcgagagggccaccatcaactgcaagtccagccagagtgttttatacagctccgacaatgagaactgcttaacttggtaccagcagaaaccaggacagcctcctaagttactcatttactgggcatctacccgggaatccggggtccctgaccgattcagtggcagcgggtctgggacagatttcactctcaccatcagcagcctgcaggctgaagatgtggcagtttattactgtcagcaacattataatattccgtacacttttggccaggggaccaaggtggaaatcaaacga

SEQ ID NO: 244 - protein, 114 aa, Artificial Sequence
  Synthetic
AIQMTQSPDSLAVSLGERATINCKSSQSVLYSSDNENCLTWYQQKPGQPPKLLIYWASTRESGVPDRFSGSGSGTDFTLTISSLQAEDVAVYYCQQHYNIPYTFGQGTKVEIKR

SEQ ID NO: 245 - DNA, 357 bp, Artificial Sequence
  Synthetic
gaggtgcagctggtgcagtctgggggaggcgtggtccagcctgggaggtccctgagactctcctgtgcagcctctggattcaccttcagtagctatggcatgcactgggtccgccaggctccaggcaaggggctggagtgggtggcagttatttcatatcaggaaagtaataaacactatgtagactccgtgaagggccgattcaccatctccagagacaattccaagaacacgctgtatctgcacatgaacagcctgagagctgaggacacggctgtgtattactgtgcgcaaagtcgtggatacagctatggtctaggttactggggccagggaaccctggtcaccgtctcctca

SEQ ID NO: 246 - protein, 119 aa, Artificial Sequence
  Synthetic
EVQLVQSGGGVVQPGRSLRLSCAASGFTFSSYGMHWVRQAPGKGLEWVAVISYQESNKHYVDSVKGRFTISRDNSKNTLYLHMNSLRAEDTAVYYCAQSRGYSYGLGYWGQGTLVTVSS

SEQ ID NO: 247 - DNA, 342 bp, Artificial Sequence
  Synthetic
gacatccagatgacccagtctccagactccctggctgtgtctctgggcgagagggccaccatcaactgcaagtccagccagagtgttttatacagctccaacaataagaactacttaacttggtaccagcagaaaccaggacagcctcctaaactgctcatttactggacatctacccgggaatccggggtccctgaccgattcagtggcagcgggtctgggacagatttcactctcaccatcagcagcctgcaggctgaagatgtggcagtttattactgtcagcaatattatagtactccgtacacttttggccaggggaccaaggtggagatcaaacga

SEQ ID NO: 248 - protein, 114 aa, Artificial Sequence; identical to SEQ ID NO: 40
  Synthetic

SEQ ID NO: 249 - DNA, 357 bp, Artificial Sequence
  Synthetic
caggtgcagctggtggagtctgggggaggcgtggtccagcctgggaggtccctgagactctcctgtgcagcctctggattcaccttcagtagttatggcatgcactgggtccgccaggctccaggcaaggggctggagtgggtggcacttatttcatatgctggaagcaataaacactatgcagactccgtgaagggccgattcaccatctccagagacgattccaagaacacgctttatctgcaaatgaacagcctgagagttgaggacacggctgtgtattactgtgcgaaaagtcgtggatacagctatggtctaggctactggggccagggaaccctggtcactgtctcctca

SEQ ID NO: 250 - protein, 119 aa, Artificial Sequence
  Synthetic
QVQLVESGGGVVQPGRSLRLSCAASGFTFSSYGMHWVRQAPGKGLEWVALISYAGSNKHYADSVKGRFTISRDDSKNTLYLQMNSLRVEDTAVYYCAKSRGYSYGLGYWGQGTLVTVSS

SEQ ID NO: 251 - DNA, 342 bp, Artificial Sequence
  Synthetic
gccatccggatgacccagtctccagactccctggctgtgtctctgggcgagagggccaccatcaactgcaagtccagccagagtgttttatacagttccgacaataagaactacttagtttggtaccagcagaaaccaggacagcctcctaacctgctcatttactgggcatctacccgggaatccggggtccctgaccgattcagtggcagcgggtctgggacagatttcactctcaccatcagcagcctgcaggctgaagatgtggcagtttattactgtcagcaacattataatcctccgtactcttttggccaggggaccaaggtggaaatcaaacga

SEQ ID NO: 252 - protein, 114 aa, Artificial Sequence
  Synthetic
AIRMTQSPDSLAVSLGERATINCKSSQSVLYSSDNKNYLVWYQQKPGQPPNLLIYWASTRESGVPDRFSGSGSGTDFTLTISSLQAEDVAVYYCQQHYNPPYSFGQGTKVEIKR

SEQ ID NO: 253 - DNA, 357 bp, Artificial Sequence
  Synthetic
caggtgcagctggtgcagtctgggggaggcgtggtccagcctgggaggtccctgagactctcctgtgcagcctctggattcaccttcagtagctatggcatgcactgggtccgccaggctccaggcaaggggctggagtgggtggcagttatttcatatcaggaaagtaataaacactatgtagactccgtgaagggccgattcaccatctccagagacaattccaagaacacactgtatctgcaaatgaacagcctgagagctgaggacacggctgtgtattactgtgcgaaaagtcgtggatacagctatggtctaggttactggggccagggaaccctggtcaccgtctcctca

SEQ ID NO: 254 - protein, 119 aa, Artificial Sequence
  Synthetic
QVQLVQSGGGVVQPGRSLRLSCAASGFTFSSYGMHWVRQAPGKGLEWVAVISYQESNKHYVDSVKGRFTISRDNSKNTLYLQMNSLRAEDTAVYYCAKSRGYSYGLGYWGQGTLVTVSS

SEQ ID NO: 255 - DNA, 342 bp, Artificial Sequence
  Synthetic
gacatccagatgacccagtctccagactccctgactgtgtctctgggcgagagggccaccatcaactgcaagtccagccagagtgttttatacagctccaacaataagaactacttaacttggtaccagcagaaaccaggacagcctcctaaactgctcatttactggacatctacccgggaatccggggtccctgaccgattcagtggcagcgggtctgggacagatttcactctcaccatcagcagcctgcaggctgaagatgtggcagtttattactgtcagcaatattatagtactccgtacacttttggccaggggaccaaggtggaaatcaaacga

SEQ ID NO: 256 - protein, 114 aa, Artificial Sequence
  Synthetic
DIQMTQSPDSLTVSLGERATINCKSSQSVLYSSNNKNYLTWYQQKPGQPPKLLIYWTSTRESGVPDRFSGSGSGTDFTLTISSLQAEDVAVYYCQQYYSTPYTFGQGTKVEIKR

SEQ ID NO: 257 - DNA, 351 bp, Artificial Sequence
  Synthetic
gaggtgcagctggtgcagtctgggggaggcttggtacagcctggggggtccctgagactctcctgtgcagcctctggattcacctttagaagctatgtcatgagctgggtccgccaggctccagggatggggctggagtgggtctcagctattactgctagtggtggtagcacatactacggagactccgtgaagggccggttcaccatctccagagacaattccaagaacacgctgtatctgcaaatgaacagcctgagagccgaggacacggccgtatattactgtgcgaaagattactatgggccgtttgactactggggccagggaaccctggtcactgtctcctca

SEQ ID NO: 258 - protein, 117 aa, Artificial Sequence
  Synthetic
EVQLVQSGGGLVQPGGSLRLSCAASGFTFRSYVMSWVRQAPGMGLEWVSAITASGGSTYYGDSVKGRFTISRDNSKNTLYLQMNSLRAEDTAVYYCAKDYYGPFDYWGQGTLVTVSS

SEQ ID NO: 259 - DNA, 324 bp, Artificial Sequence
  Synthetic
gacatccagatgacccagtctccagactttcagtctgtgactccaaaggagaaagtcaccatcacctgccgggccagtcagagtattggtagtagcttacactggtaccagcagaaaccggatcagtctccaaagctcctcatcaagtatgcttcccagtccttctcaggggtcccctcgaggttcagtggcagtggatctgggacagatttcaccctcatgatcaacagcctggaagctgaagatgctgcaacgtattactgtcatcagagtggtggtttaccgtggacgttcggccaagggaccaaggtggaaatcaaacga

SEQ ID NO: 260 - protein, 108 aa, Artificial Sequence
  Synthetic
DIQMTQSPDFQSVTPKEKVTITCRASQSIGSSLHWYQQKPDQSPKLLIKYASQSFSGVPSRFSGSGSGTDFTLMINSLEAEDAATYYCHQSGGLPWTFGQGTKVEIKR

SEQ ID NO: 261 - DNA, 357 bp, Artificial Sequence
  Synthetic
caggtgcagctggtggagtcggggggaggcgtggtccagcctgggaggtccctgagactctcctgtgcagcctctggattcaccttcagtagctatggcatgcactgggtccgccaggctccaggcaaggggctggagtgggtggctcttatatcatatgttggaagtaataaacactatgcagactccgtgaagggccgattcaccatttccagagacaattccaaaaacacgctgtatctgcaaatgaacagcctgagagctgaggacacggctgtgtattactgtgcgaaaagtcgtggatacagctatggtctagactactggggccagggaaccctggtcaccgtctcctca

SEQ ID NO: 262 - protein, 119 aa, Artificial Sequence
  Synthetic
QVQLVESGGGVVQPGRSLRLSCAASGFTFSSYGMHWVRQAPGKGLEWVALISYVGSNKHYADSVKGRFTISRDNSKNTLYLQMNSLRAEDTAVYYCAKSRGYSYGLDYWGQGTLVTVSS

SEQ ID NO: 263 - DNA, 342 bp, Artificial Sequence
  Synthetic
gacatccagatgacccagtctccggactccctggctgtgtctctgggcgagagggccaccatcaactgcaagtccagccagactgttttacacagctccaacaatcagaacaacttagtctggtaccagcagaaaccaggacagcctcctaagctgctcatttactgggcttctacccgggaatccggggtccctgaccgattcagtggcagcgggtctgggacagatttcactctcaccatcagcagcctgcaggctgaagatgtggcaatttattactgtcagcaatattatagtactccgtacacttttggccaggggaccaagctggagatcaaacga

SEQ ID NO: 264 - protein, 114 aa, Artificial Sequence
  Synthetic
DIQMTQSPDSLAVSLGERATINCKSSQTVLHSSNNQNNLVWYQQKPGQPPKLLIYWASTRESGVPDRFSGSGSGTDFTLTISSLQAEDVAIYYCQQYYSTPYTFGQGTKLEIKR

SEQ ID NO: 265 - DNA, 357 bp, Artificial Sequence
  Synthetic
caggtgcagctggtgcagtctgggggaggcgtggtccagcctgggaggtccctgagactctcctgtgcagcctctggattctccttcagtagctttggcatgcactgggtccgccaggctccaggcaaggggctggagtgggtggcagttatatcatatggtggaattaataaacactattcagactccgtgaagggccgattcaccatctccagagacgattccaagaacacgctgtatctgcaaatgaacagtttgagagctgaggacacggctgtctattactgtgcgaaaagggagggatacaggtatgcttacgactactggggccagggaaccctggtcaccgtctcctca

SEQ ID NO: 266 - protein, 119 aa, Artificial Sequence; identical to SEQ ID NO: 34
  Synthetic

SEQ ID NO: 267 - DNA, 324 bp, Artificial Sequence
  Synthetic
gacatccagatgacccagtctccatcctcactgtctgcatctgtaggagacagagtcaccatcacttgtcgggcgagtcagggcattagcaattatttagcctggtttcagcagaaaccagggaaagcccctaagtccctgatctatggtgcatccagtttgcaaagtggggtcccatcaaagttcagcggcagtggatctgggacagatttcactctcaccatcagcagcctgcagcctgaagattttgcaacttattactgccaacagtataatagttacccactcactttcggcggggggaccaaggtggaaatcaaacga

SEQ ID NO: 268 - protein, 108 aa, Artificial Sequence; identical to SEQ ID NO: 36
  Synthetic

SEQ ID NO: 269 - DNA, 357 bp, Artificial Sequence
  Synthetic
caggtgcagctggtgcagtctgggggaggcgtggtccagcctgggaggtccctgagactctcctgtgcagcctctggattcaccttcagtagctatggcatgcactgggtccgccaggctccaggcaaggggctggagtgggtggcagttatttcatatcaggaaagtaataaacactatgtagactccgtgaagggccgattcaccatctccagagacaattccaagaacacgctgtatctgcaaatgaacagcctgagagctgaggacacggctgtgtattactgtgcgaaaagtcgtggatacagctatggtctaggttactggggccagggaaccctggtcaccgtctcttca

SEQ ID NO: 270 - protein, 119 aa, Artificial Sequence; identical to SEQ ID NO: 254
  Synthetic

SEQ ID NO: 271 - DNA, 342 bp, Artificial Sequence
  Synthetic
gacatccagatgacccagtctccagactccctggctgtgtctctgggcgagagggccaccatcaactgcaagtccagccagagtgttttattcatctccaacaataagaactacttaacttggtaccagcagaaaccaggacagcctcctaaactgctcatttactggacatctacccgggaatccggggtccctgaccgattcagtggcagcgggtctgggacagatttcactctcaccatcagcagcctgcaggctgaagatgtggcagtttattactgtcagcaatattatagtactccgtacacttttggccaggggaccaaggtggagatcaaacga

SEQ ID NO: 272 - protein, 114 aa, Artificial Sequence
  Synthetic
DIQMTQSPDSLAVSLGERATINCKSSQSVLFISNNKNYLTWYQQKPGQPPKLLIYWTSTRESGVPDRFSGSGSGTDFTLTISSLQAEDVAVYYCQQYYSTPYTFGQGTKVEIKR

SEQ ID NO: 273 - DNA, 357 bp, Artificial Sequence
  Synthetic
caggtgcagctggtggagtctgggggaggcgtggtccagcctgggaggtccctgagactctcctgtgcagcctctggattctccttcagtagctttggcatgcactgggtccgccaggctccaggcaaggggctggagtgggtggcagttatatcatatggtggaattaataaacactattcagactccgtgaagggccggttcaccatctccagagacgattccaagaacacgctgtatctgcaaatgaacagcctgagagctgaggacacggctgtctattactgtgcgaaaagggagggatacaggtatgcttacgactactggggccagggaaccctggtcactgtctcctca

SEQ ID NO: 274 - protein, 119 aa, Artificial Sequence
  Synthetic
QVQLVESGGGVVQPGRSLRLSCAASGFSFSSFGMHWVRQAPGKGLEWVAVISYGGINKHYSDSVKGRFTISRDDSKNTLYLQMNSLRAEDTAVYYCAKREGYRYAYDYWGQGTLVTVSS

SEQ ID NO: 275 - DNA, 324 bp, Artificial Sequence
  Synthetic
gacatccagatgacccagtctccatcctcactgtctgcatctgtaggagacagagtcaccatcacttgtcgggcgagtcagggcattagcaattatttagcctggtttcagcagaaaccagggaaagcccctaagtccctgatctatggtgcatccagtttgcaaagtggggtcccatcaaagttcagcggcagtggatctgggacagatttcactctcaccatcagcagcctgcagcctgaagattttgcaacttattactgccaacagtataatagttacccgctcactttcggcggggggaccaaggtggagatcaaacga

SEQ ID NO: 276 - protein, 108 aa, Artificial Sequence; identical to SEQ ID NO: 36
  Synthetic

SEQ ID NO: 277 - DNA, 357 bp, Artificial Sequence
  Synthetic
gaggtgcagctggtgcagtctgggggaggcgtggtccagcctgggaggtccctgagactctcctgtgcagcctctggattcaccttcagtagctatggcatgcactgggtccgccaggctccaggcaaggggctggagtgggtggcagttatttcatatcaggaaagtaataaacactatgtagactccgtgaagggccgattcaccatctccagagacaattccaagaacacgctgtatctgcaaatgaacagcctgagagctgaggacacggctgtgtattactgtgcgaaaagtcgtggatacagctatggtctaggttactggggccagggaaccatggtcactgtctcttca

SEQ ID NO: 278 - protein, 119 aa, Artificial Sequence
  Synthetic
EVQLVQSGGGVVQPGRSLRLSCAASGFTFSSYGMHWVRQAPGKGLEWVAVISYQESNKHYVDSVKGRFTISRDNSKNTLYLQMNSLRAEDTAVYYCAKSRGYSYGLGYWGQGTMVTVSS

SEQ ID NO: 279 - DNA, 342 bp, Artificial Sequence
  Synthetic
gacatccagatgacccagtctccaaactccctggaagtgtctctgggcgagagggccaccatcaactgcaagtccagccagagtgttttatccacctccaacaataagaactacttaacttggtaccagcagaaaccaggacagcctcctaacctgctcatttactgggcatctacccgtgaatccggggtccctgaccgattcactggcagcgggtctgggacagatttcactctcaccatcagcagcctgcaggctgaagatgtggcagtttattactgtcagcaatattataatattccgtacacttttggccaggggaccaaggtggaaatcaaacga

SEQ ID NO: 280 - protein, 114 aa, Artificial Sequence
  Synthetic
DIQMTQSPNSLEVSLGERATINCKSSQSVLSTSNNKNYLTWYQQKPGQPPNLLIYWASTRESGVPDRFTGSGSGTDFTLTISSLQAEDVAVYYCQQYYNIPYTFGQGTKVEIKR

SEQ ID NO: 281 - DNA, 357 bp, Artificial Sequence
  Synthetic
gaggtgcagctggtggagtctgggggaggcgtggtccagcctgggaggtccctgagaatctcctgtgcagcctctggattcaccttcagttcctacggcatgcactgggtccgccacgctccaggcaaggggctggagtgggtggcaatgatatcatatgagggaagtaatagacactatgtggactccgtgaagggccgattcaccatctccagagacaattccaacaatacgctgtatctgcaaatgaacagtctgagagctgaggacacggctgtgtatttctgtgcgaaaaggaattctacgaagggttattttgatatctggggccaagggacaatggtcaccgtctcctca

SEQ ID NO: 282 - protein, 119 aa, Artificial Sequence
  Synthetic
EVQLVESGGGVVQPGRSLRISCAASGFTFSSYGMHWVRHAPGKGLEWVAMISYEGSNRHYVDSVKGRFTISRDNSNNTLYLQMNSLRAEDTAVYFCAKRNSTKGYFDIWGQGTMVTVSS

SEQ ID NO: 283 - DNA, 324 bp, Artificial Sequence
  Synthetic
gacatccagatgacccagtctccatcttccgtgtctgcatctgtaggagacagagtcatcatcacttgtcgggcgagtcagggtattcgcacctggttagcctggtatcagcagaaaccagggaaagcccctaagctcctgatctatgctgcatccagtttgcaaagtggggtcccatcaaggttcagcggcagtggatctgggacagagttcactctcaccatcagcagcctgcagcctgaagattttgtaacttactattgtcaacaggttaacagtttcccgctcactttcggcggagggaccaaggtggagatcaaacga

SEQ ID NO: 284 - protein, 108 aa, Artificial Sequence
  Synthetic
DIQMTQSPSSVSASVGDRVIITCRASQGIRTWLAWYQQKPGKAPKLLIYAASSLQSGVPSRFSGSGSGTEFTLTISSLQPEDFVTYYCQQVNSFPLTFGGGTKVEIKR

SEQ ID NO: 285 - DNA, 357 bp, Artificial Sequence
  Synthetic
caggtgcagctggtgcagtctgggggaggcgtggtccagcctgggaggtccctgagactctcctgtgcagcctctggattcaccttcagtagctatggcatgcactgggtccgccaggctccaggcaaggggctggagtgggtgacagttatatcatatgatggaagtaatagaaactatgcagactccgtgaagggccgattcaccatctccagagacaattccgagaacacgctgtatctgcaaatgaacagcctgagagctgacgacacggctgtgtattactgtgcgcaaagtcgtggatacagctatggtctagggtactggggccagggaaccctggtcaccgtctcctca

SEQ ID NO: 286 - protein, 119 aa, Artificial Sequence
  Synthetic
QVQLVQSGGGVVQPGRSLRLSCAASGFTFSSYGMHWVRQAPGKGLEWVTVISYDGSNRNYADSVKGRFTISRDNSENTLYLQMNSLRADDTAVYYCAQSRGYSYGLGYWGQGTLVTVSS

SEQ ID NO: 287 - DNA, 324 bp, Artificial Sequence
  Synthetic
gacatccagatgacccagtctccatcctccctgtctgcatctgtaggagacagagtcaccatcacttgccgggcgagtcagggcattagcaattatttagcctggtatcagcagaaaccagggaaagttcctaagctcctgatctatgctgcatccactttgcaatcaggggtcccatctcggttcagtggcagtggatctgggacagatttcactctcaccatcagcagcctgcagcctgaagatgttgcaacttattactgtcaaaagtataacagtgccccattcactttcggccctgggaccaaggtggagatcaaacga

SEQ ID NO: 288 - protein, 108 aa, Artificial Sequence
  Synthetic
DIQMTQSPSSLSASVGDRVTITCRASQGISNYLAWYQQKPGKVPKLLIYAASTLQSGVPSRFSGSGSGTDFTLTISSLQPEDVATYYCQKYNSAPFTFGPGTKVEIKR

SEQ ID NO: 289 - DNA, 357 bp, Artificial Sequence
  Synthetic
caggtgcagctggtgcagtctgggggaggcgtggtccagcctgggaggtccctgagactctcctgtgcagcctctggattcaccttcagtagttatggcatgcactgggtccgccaggctccaggcaaggggctggagtgggtggcacttatttcatatgctggaagcaataaacactatgcagactccgtgaagggccgattcaccatctccagagacgattccaagaacacgctttatctgcaaatgaacagcctgagagttgaggacacggctgtgtattactgtgcgaaaagtcgtggatacagctatggtctaggctactggggccagggaaccatggtcaccgtctcctca

SEQ ID NO: 290 - protein, 119 aa, Artificial Sequence
  Synthetic
QVQLVQSGGGVVQPGRSLRLSCAASGFTFSSYGMHWVRQAPGKGLEWVALISYAGSNKHYADSVKGRFTISRDDSKNTLYLQMNSLRVEDTAVYYCAKSRGYSYGLGYWGQGTMVTVSS

SEQ ID NO: 291 - DNA, 342 bp, Artificial Sequence
  Synthetic
gccatccagatgacccagtctccagactccctggctgtgtctctgggcgagagggccaccatcaactgcaagtccagccagagtgttttatacagttccgacaataagaactacttagtttggtaccagcagaaaccaggacagcctcctaacctgctcatttactgggcatctacccgggaatccggggtccctgaccgattcagtggcagcgggtctgggacagatttcactctcaccatcagcagcctgcaggctgaagatgtggcagtttattactgtcagcaacattataatcctccgtactcttttggccaggggaccaaggtggaaatcaaacga

SEQ ID NO: 292 - protein, 114 aa, Artificial Sequence
  Synthetic
AIQMTQSPDSLAVSLGERATINCKSSQSVLYSSDNKNYLVWYQQKPGQPPNLLIYWASTRESGVPDRFSGSGSGTDFTLTISSLQAEDVAVYYCQQHYNPPYSFGQGTKVEIKR

SEQ ID NO: 293 - DNA, 357 bp, Artificial Sequence
  Synthetic
caggtgcagctggtgcagtctgtgggaggcgtggtccagcctgggaggtccctgagactctcctgtgcagcctctggattcaccttcagtagctatggcatgcactgggtccgccaggctccaggcaaggggctggagtgggtggcacttatatcatatgctggaattaatgaatactatgcagactccgtgaagggccgattcaccatttccagagacgattccaagaacacgctgtatctgcaaatgaacagcctgagagttgaggacacggctgtgtattactgtgccaaaagtcgtggatacagctatggtctaggctactggggccagggaaccctggtcaccgtctcctca

SEQ ID NO: 294 - protein, 119 aa, Artificial Sequence
  Synthetic
QVQLVQSVGGVVQPGRSLRLSCAASGFTFSSYGMHWVRQAPGKGLEWVALISYAGINEYYADSVKGRFTISRDDSKNTLYLQMNSLRVEDTAVYYCAKSRGYSYGLGYWGQGTLVTVSS

SEQ ID NO: 295 - DNA, 342 bp, Artificial Sequence
  Synthetic
gacatccagatgacccagtctccagactccctggctgtgtctctgggcgagagggccaccatcaactgcaagtccagccagagtgttttatacagctccaacaataagaactacttagtttggtaccaacagaaaccaggacagcctcctaacctgctcatttactgggcatctacccgggaatccggggtccctgaccgattcagtggcagcgggtctgggacagatttcactctcaccatcagcagcctgcaggctgaagatgtggcagtttattactgtcagcaatattataatcctccgtacacttttggccaggggaccaaggtggaaatcaaacga

SEQ ID NO: 296 - protein, 114 aa, Artificial Sequence; identical to SEQ ID NO: 56
  Synthetic

SEQ ID NO: 297 - DNA, 357 bp, Artificial Sequence
  Synthetic
caggtgcagctggtacagtcggggggaggcgtggtccagcctgggaggtccctgagactctcctgtgcagcctctggattcaccttcagtagctatggcatgcactgggtccgccaggctccaggcaaggggctggagtgggtggctcttatatcatatgttggaagtaataaacactatgcagactccgtgaagggccgattcaccatttccagagacaattccaaaaacacgctgtatctgcaaatgaacagcctgagagctgaggacacggctgtgtattactgtgcgaaaagtcgtggatacagctatggtctagactactggggccagggaaccctggtcactgtctcctca

SEQ ID NO: 298 - protein, 119 aa, Artificial Sequence
  Synthetic
QVQLVQSGGGVVQPGRSLRLSCAASGFTFSSYGMHWVRQAPGKGLEWVALISYVGSNKHYADSVKGRFTISRDNSKNTLYLQMNSLRAEDTAVYYCAKSRGYSYGLDYWGQGTLVTVSS

SEQ ID NO: 299 - DNA, 342 bp, Artificial Sequence
  Synthetic
gacatccagatgacccagtctccggactccctggctgtgtctctgggcgagagggccaccatcaactgcaagtccagccagactgttttacacagctccaacaatcagaacaacttagtctggtaccagcagaaaccaggacagcctcctaagctgctcatttactgggcttctacccgggaatccggggtccctgaccgattcagtggcagcgggtctgggacagatttcactctcaccatcagcagcctgcaggctgaagatgtggcaatttattactgtcagcaatattatagtactccgtacacttttggccaggggaccaaggtggaaatcaaacga

SEQ ID NO: 300 - protein, 114 aa, Artificial Sequence
  Synthetic
DIQMTQSPDSLAVSLGERATINCKSSQTVLHSSNNQNNLVWYQQKPGQPPKLLIYWASTRESGVPDRFSGSGSGTDFTLTISSLQAEDVAIYYCQQYYSTPYTFGQGTKVEIKR

SEQ ID NO: 301 - DNA, 357 bp, Artificial Sequence
  Synthetic
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatttcatatcaggaaagtaataaacactatgtagactccgtgaagggccgattcaccatctccagagacaattccaagaacacgctgtatctgcaaatgaacagcctgagagctgaggacacggctgtgtattactgtgcgaaaagtcgtggatacagctatggtctaggttactggggccagggaaccctggtcaccgtctcctca

SEQ ID NO: 302 - protein, 119 aa, Artificial Sequence
  Synthetic
QVQLVESGGGVVQPGRSLRLSCAASGFTFSSYGMHWVRQAPGKGLEWVAVISYQESNKHYVDSVKGRFTISRDNSKNTLYLQMNSLRAEDTAVYYCAKSRGYSYGLGYWGQGTLVTVSS

SEQ ID NO: 303 - DNA, 342 bp, Artificial Sequence
  Synthetic
gccatccggatgacccagtctccagactccctggctgtgtctctgggcgagagggccaccatcaactgcaagtccagccagagtgttttatacagctccaacaataagaactacttaacttggtaccagcagaaaccaggacagcctcctaaactgctcatttactggacatctacccgggaatccggggtccctgaccgattcagtggcagcgggtctgggacagatttcactctcaccatcagcagcctgcaggctgaagatgtggcagtttattactgtcagcaatattatagtactccgtacacttttggccaggggaccaaggtggaaatcaaacga

SEQ ID NO: 304 - protein, 114 aa, Artificial Sequence
  Synthetic
AIRMTQSPDSLAVSLGERATINCKSSQSVLYSSNNKNYLTWYQQKPGQPPKLLIYWTSTRESGVPDRFSGSGSGTDFTLTISSLQAEDVAVYYCQQYYSTPYTFGQGTKVEIKR

SEQ ID NO: 305 - DNA, 366 bp, Artificial Sequence
  Synthetic
caggtgcagctggtggagtctgggggaggcttggtacagcctggggggtccctgagactctcctgtgtagcctctggattcacctttagtagctatgccatgagctgggtccgccaggctccagggaaggggctggagtgggtctcaggtattagtggtagtggtggtaacacatactacgcagactccgtgaagggccgattcaccatctccagagacaactccgagaatacgctgtatctgcaaatgaacagcctgagagccgaggacacggccgtatatcactgtgcgaaagatccgcatagcagcaggtggcccggattcttcgatctctggggccgtggcaccctggtcactgtctcctca

SEQ ID NO: 306 - protein, 122 aa, Artificial Sequence
  Synthetic
QVQLVESGGGLVQPGGSLRLSCVASGFTFSSYAMSWVRQAPGKGLEWVSGISGSGGNTYYADSVKGRFTISRDNSENTLYLQMNSLRAEDTAVYHCAKDPHSSRWPGFFDLWGRGTLVTVSS

SEQ ID NO: 307 - DNA, 342 bp, Artificial Sequence
  Synthetic
gacatccagatgacccagtctccagactccctggctgtgtctctgggcgagagggccaccatcaactgcaagtccagccagagtgttttatacagctccaacaataagaactacttagcttggtaccagcagaaaccaggacagcctcctaagctcctcatttactgggcatctacccgggaatccggggtccctgaccgattcagtggcagcgggtctgggacagatttcactctcaccatcagcagcctgcaggctgaagatgtggcagtttattactgtcagcaatattatagttctccgtacacttttggccaggggaccaaggtggaaatcaaacga

SEQ ID NO: 308 - protein, 114 aa, Artificial Sequence
  Synthetic
DIQMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSSPYTFGQGTKVEIKR

SEQ ID NO: 309 - DNA, 366 bp, Artificial Sequence
  Synthetic
caggtgcagctggtgcagtctgggggaggcttggtacagcctggggggtccctgagactctcctgtgcagcctctggattcacctttagcaactatgccatgagctgggtccgccaggctccagggaaggggctggagtgggtctcagctattagtggtagtggtgataacacatactacgcagactccgtgaggggccggttcaccatctccagagacaattccaagaacacgctgtatctgcaaatgaacagtctgagagccgaggacacggccatatattactgtgcgaaagatccgcatagcagcaggtggcccgggttcttcgatctctggggccgtggcaccctggtcaccgtctcctca

SEQ ID NO: 310 - protein, 122 aa, Artificial Sequence
  Synthetic
QVQLVQSGGGLVQPGGSLRLSCAASGFTFSNYAMSWVRQAPGKGLEWVSAISGSGDNTYYADSVRGRFTISRDNSKNTLYLQMNSLRAEDTAIYYCAKDPHSSRWPGFFDLWGRGTLVTVSS

SEQ ID NO: 311 - DNA, 342 bp, Artificial Sequence
  Synthetic
gacatccagatgacccagtctccagactccctggctgtgtctctgggcgagagggccaccatcaactgcaagtccagccagagtgttttatacagctccaacaatcagaattacttagcttggtaccagcagaaaccaggacagcctcctaaactgctcatttactgggcatctacccgggaatccggggtccctgaccgattcagtggcagcgggtctgggacagatttcactctcaccatcagtagcctgcaggctgaagatgtggcagtttattactgtcagcaatattatagtactccgtacacttttggccaggggaccaaggtggaaatcaaacga

SEQ ID NO: 312 - protein, 114 aa, Artificial Sequence
  Synthetic
DIQMTQSPDSLAVSLGERATINCKSSQSVLYSSNNQNYLAWYQQKPGQPPKLLIYWASTRESGVPDRFSGSGSGTDFTLTISSLQAEDVAVYYCQQYYSTPYTFGQGTKVEIKR

SEQ ID NO: 313 - DNA, 363 bp, Artificial Sequence
  Synthetic
caggtgcagctgcagcagtggggcgcaggactgttgacgccttcggagaccctgtccctcacctgcgctgtctatggtgggtccttcagtggtcactactggagctggatccgccagcccccagggaaggggctggaatggattggggaaatcaatcctagaggaagcaccaactataaaccgtccctcaagagtcgagtcaccatatcagtagacacgtccaagaaccagttctccctgaacctgaggtctgtgaccgccgcggacacggctatgtattactgtgcgagagagggtaatttggcagctcgtctctggttcttcgatctctggggccgtggcaccctggtcaccgtctcctca

SEQ ID NO: 314 - protein, 121 aa, Artificial Sequence
  Synthetic
QVQLQQWGAGLLTPSETLSLTCAVYGGSFSGHYWSWIRQPPGKGLEWIGEINPRGSTNYKPSLKSRVTISVDTSKNQFSLNLRSVTAADTAMYYCAREGNLAARLWFFDLWGRGTLVTVSS

SEQ ID NO: 315 - DNA, 324 bp, Artificial Sequence
  Synthetic
gacatccagatgacccagtctccatcctccctgtctgcatctgtaggagacagaggcaccatcacttgccggacaagtcagagcattcgcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttacttctgtcaacagagttacagttccccgttcacttttggccaggggaccaaggtggaaatcaaacga

SEQ ID NO: 316 - protein, 108 aa, Artificial Sequence
  Synthetic
DIQMTQSPSSLSASVGDRGTITCRTSQSIRSYLNWYQQKPGKAPKLLIYAASSLQSGVPSRFSGSGSGTDFTLTISSLQPEDFATYFCQQSYSSPFTFGQGTKVEIKR

SEQ ID NO: 317 - DNA, 342 bp, Artificial Sequence
  Synthetic
caggtgcagctggtgcagtctgggggaggcttggtacagcctggggggtccctgagactctcctgtgcagcctctggattcacctttagcagctatgccatgaactgggtccgccaggctccagggaagggactggagtgggtctcaactattagtggtagtggtggtagcacatactacgcagactccgtgaagggccggttcaccttctccagagacaattccaagaacacgctgtatctgcaaatgaacaacctgagagccgaggacacggccgtatattactgtgcgaaagtcggaggagacgtctggggccaagggaccacggtcaccgtctcctca

SEQ ID NO: 318 - protein, 114 aa, Artificial Sequence
  Synthetic
QVQLVQSGGGLVQPGGSLRLSCAASGFTFSSYAMNWVRQAPGKGLEWVSTISGSGGSTYYADSVKGRFTFSRDNSKNTLYLQMNNLRAEDTAVYYCAKVGGDVWGQGTTVTVSS

SEQ ID NO: 319 - DNA, 342 bp, Artificial Sequence
  Synthetic
gacatccagatgacccagtctccagagtccctggctgtgtctctgggcgagagggccaccatcaactgcaagtccagccagagtgttttagacagctccaacaataggaactacttagcttggtaccagcagaaaccaggacagcctcctaaactgttcatttactgggcatctacccgggaatccggggtccctgaccgattcagtggcagcgggtctgggacagatttcactctcaccatcagcagcctgcaggctgaagatgtggcagtttattactgtcagcaatattatagtactcctctcactttcggcggagggaccaagctggagatcaaacga

SEQ ID NO: 320 - protein, 114 aa, Artificial Sequence
  Synthetic
DIQMTQSPESLAVSLGERATINCKSSQSVLDSSNNRNYLAWYQQKPGQPPKLFIYWASTRESGVPDRFSGSGSGTDFTLTISSLQAEDVAVYYCQQYYSTPLTFGGGTKLEIKR

SEQ ID NO: 321 - DNA, 366 bp, Artificial Sequence
  Synthetic
caggtgcagctggtgcagtctgggggaggcttggtacagcctggggggtccctgagactctcctgtgcagcctctggattcacctttagcaactatgccatgagctgggtccgccaggctccagggaaggggctggagtgggtctcagctattagtggtagtggtgataacacatactacgcagactccgtgaggggccggttcaccatctccagagacaattccaagaacacgctgtatctgcaaatgaacagtctgagagccgaggacacggccgtatattactgtgcgaaagatccgcatagcagcaggtggcccgggttcttcgatctctggggccgtggcaccctggtcacggtctcctca

SEQ ID NO: 322 - protein, 122 aa, Artificial Sequence
  Synthetic
QVQLVQSGGGLVQPGGSLRLSCAASGFTFSNYAMSWVRQAPGKGLEWVSAISGSGDNTYYADSVRGRFTISRDNSKNTLYLQMNSLRAEDTAVYYCAKDPHSSRWPGFFDLWGRGTLVTVSS

SEQ ID NO: 323 - DNA, 324 bp, Artificial Sequence
  Synthetic
gacatccagatgacccagtctccatcctccctgtctgcatctgtaggagacagagtcaccatcacttgccgggcgagtcagggcattagcaattatttagcctggtatcagcagaaaccagggaaagttcctaagctcctgatctatgctgcatccactttgcaatcaggggtcccatctcggttcagtggcagtggatctgggacagatttcactctcaccatcagcagcctgcagcctgaagatgttgcaacttattactgtcaaaagtataacagtgccccgctcactttcggcggagggaccaaggtggaaatcaaacga

SEQ ID NO: 324 - protein, 108 aa, Artificial Sequence
  Synthetic
DIQMTQSPSSLSASVGDRVTITCRASQGISNYLAWYQQKPGKVPKLLIYAASTLQSGVPSRFSGSGSGTDFTLTISSLQPEDVATYYCQKYNSAPLTFGGGTKVEIKR

SEQ ID NO: 325 - DNA, 384 bp, Artificial Sequence
  Synthetic
caagtgcagctggtgcagtctgggggaggcttggtacagcctggcaggtccctgagactctcctgtgcagcctctggattcacctttgatgattatgccatgcactgggtccggcaaactccagggaagggcctggagtgggtctcaggtattagttggaatagtggtagcataggctatgcggactctgtgaagggccgattcaccatctccagagacaacgccaagaactccctgtatctgcaaatgaacagtctgataactgaggacacggccttgtattactgtgcaaaagatatggaatattacgatattttgactggttattatagctactacattatggacgtctggggccaagggaccacggtcaccgtctcctca

SEQ ID NO: 326 - protein, 128 aa, Artificial Sequence
  Synthetic
QVQLVQSGGGLVQPGRSLRLSCAASGFTFDDYAMHWVRQTPGKGLEWVSGISWNSGSIGYADSVKGRFTISRDNAKNSLYLQMNSLITEDTALYYCAKDMEYYDILTGYYSYYIMDVWGQGTTVTVSS

SEQ ID NO: 327 - DNA, 324 bp, Artificial Sequence
  Synthetic
gacatccagatgacccagtctccatccttcctgtctgcatctgtaggagacagagtcaccatcacttgctgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcagcagtttaatagttaccctccgacgttcggccaagggaccaaggtggaaatcaaacga

SEQ ID NO: 328 - protein, 108 aa, Artificial Sequence; identical to SEQ ID NO: 64
  Synthetic

SEQ ID NO: 329 - DNA, 339 bp, Artificial Sequence
  Synthetic
caggtgcagctggtggagtctgggggaggcttggtacagccgggggggtccctgagactctcctgtgcagcctctggattcacctttagcagctatgccatgaactgggtccgccaggctccagggaaggggctggagtgggtctcaactattagtggtagtggtggtagcacatactacccagactccgtgaagggccggttcaccatctccagagacaattccaagaacacgttgtatctgcaaatgaacagcctgaaagccgaggacacggccgtatattactgtgcgaaagtcggaggagacgtctggggccaagggaccacggtcatgttctct

SEQ ID NO: 330 - protein, 113 aa, Artificial Sequence
  Synthetic
QVQLVESGGGLVQPGGSLRLSCAASGFTFSSYAMNWVRQAPGKGLEWVSTISGSGGSTYYPDSVKGRFTISRDNSKNTLYLQMNSLKAEDTAVYYCAKVGGDVWGQGTTVMFS

SEQ ID NO: 331 - DNA, 342 bp, Artificial Sequence
  Synthetic
gacatccggatgacccagtctccagactccctggctgtgtctctgggcgagagggccaccatcaactgcaagtccagccagagtgttttatccagctccaacaataagaactacttagcttggtaccagcaaaaaccaggacagcctcctaaactgctcatttactgggcatctacccgggaatccggggtccctgaccgattcagtggcagcgggtctgggacagatttcagtctcaccatcagcagcctgcaggctgaagatttggcagtttattactgtcagcaatattatagtactcctctcactttcggcggagggaccaaggtggaaatcaaacga

SEQ ID NO: 332 - protein, 114 aa, Artificial Sequence
  Synthetic
DIRMTQSPDSLAVSLGERATINCKSSQSVLSSSNNKNYLAWYQQKPGQPPKLLIYWASTRESGVPDRFSGSGSGTDFSLTISSLQAEDLAVYYCQQYYSTPLTFGGGTKVEIKR

SEQ ID NO: 333 - DNA, 381 bp, Artificial Sequence
  Synthetic
caggtgcagctggtgcagtctgggggaggcttggtcaagcctggagggtccctgagactctcctgtgcagcctctggagtcaccttcagtgactactacatgaactggatccgccaggctccagggaaggggctggagtgggtttcatacattagtactagtggtagtatcatatactacacagactctgtgaagggccgattcaccatctccagggacaacgccaagaactcactgtatctgcaaatgaacagcctgagagccgaggacacggccgtatattactgtgcgggaggggttgactccgatgactacgaggattactactcctactacgatatggacgtctggggccaagggaccacggtcaccgtctcctca

SEQ ID NO: 334 - protein, 127 aa, Artificial Sequence
  Synthetic
QVQLVQSGGGLVKPGGSLRLSCAASGVTFSDYYMNWIRQAPGKGLEWVSYISTSGSIIYYTDSVKGRFTISRDNAKNSLYLQMNSLRAEDTAVYYCAGGVDSDDYEDYYSYYDMDVWGQGTTVTVSS

SEQ ID NO: 335 - DNA, 324 bp, Artificial Sequence
  Synthetic
gacatccagatgacccagtctccatcctcactgtctgcatctgtaggagacagagtcaccatcacttgtcgggcgagtcagggcattaacaattatttagcctggtttcagcagaaaccagggaaagcccctaagtccctgatctatgctgcatccagtttgcaaagtggggtcccatcaaagttcagcggcagtggatctgggacagatttcactctcaccatcagcagcctgcagcctgaagatgttgcaatttattactgccaacagtataatagttaccctctcactttcggcggagggaccaaggtggagatcaaacga

SEQ ID NO: 336 - protein, 108 aa, Artificial Sequence
  Synthetic
DIQMTQSPSSLSASVGDRVTITCRASQGINNYLAWFQQKPGKAPKSLIYAASSLQSGVPSKFSGSGSGTDFTLTISSLQPEDVAIYYCQQYNSYPLTFGGGTKVEIKR

SEQ ID NO: 337 - DNA, 360 bp, Artificial Sequence
  Synthetic
gaagtgcagctggtgcagtctgggggaggcttggtacagcctggggggtccctgagactctcctgtgcagcctctggattcacctttagcagctatgccatgagttgggtccgccaggctccagggaaggggctggagtgggtctcagctattagtggtagtggtgattacacatactacgcagactccgtgaagggccggttcaccatctccagagacaattccaagaacacgctgtatctgcaaatgagcagcctgagagccgaagacacggccgtatattactgtgcgaaatacagttatggcctctactactacttcgatctctggggccgtggcaccctggtcaccgtctcctca

SEQ ID NO: 338 - protein, 120 aa, Artificial Sequence
  Synthetic
EVQLVQSGGGLVQPGGSLRLSCAASGFTFSSYAMSWVRQAPGKGLEWVSAISGSGDYTYYADSVKGRFTISRDNSKNTLYLQMSSLRAEDTAVYYCAKYSYGLYYYFDLWGRGTLVTVSS

SEQ ID NO: 339 - DNA, 342 bp, Artificial Sequence
  Synthetic
gacatccagttgacccagtctccagactccctggctgtgtctctgggcgagagggccaccatcaactgcaagtccagccagagtgttttatatagttccaacaataagaactatctagcttggtaccagcagaaaccaggacagcctcctaagttgctcttttactgggcatctacccgggaatccggggtccctgaccgcttcagtggcagcgggtctgggacagatttcactctcaccatcagcagcctgcaggctgaagatgtggcagtttattactgtcaccaatcttataatattccgtacacttttggccaggggaccaaggtggaaatcaaacga

SEQ ID NO: 340 - protein, 114 aa, Artificial Sequence
  Synthetic
DIQLTQSPDSLAVSLGERATINCKSSQSVLYSSNNKNYLAWYQQKPGQPPKLLFYWASTRESGVPDRFSGSGSGTDFTLTISSLQAEDVAVYYCHQSYNIPYTFGQGTKVEIKR

SEQ ID NO: 341 - DNA, 366 bp, Artificial Sequence
  Synthetic
caggtgcagctggtgcagtctgggggaggcttggtaaagcctggggggtcccttagactctcctgtgcagcctctggattcactttcagtaacgcctggatgagttgggtccgccaggctccagggaaggggctggagtggattggccgtattaaaagtaaaactgatggtgggacaacagactacgctgcacccgtgaaaggcagattcaccatttcaagagatgattcaaaaaacacgctgtatctgcaaatgaacagcctgaaaaccgaggacacagccgcatattactgtttcacagacgatttttggagtggggattatacgcactgctggggccagggaaccctggtcaccgtctcctca

SEQ ID NO: 342 - protein, 122 aa, Artificial Sequence
  Synthetic
QVQLVQSGGGLVKPGGSLRLSCAASGFTFSNAWMSWVRQAPGKGLEWIGRIKSKTDGGTTDYAAPVKGRFTISRDDSKNTLYLQMNSLKTEDTAAYYCFTDDFWSGDYTHCWGQGTLVTVSS

SEQ ID NO: 343 - DNA, 339 bp, Artificial Sequence
  Synthetic
gacatccagatgacccagtctccactctccctgcccgtcacccctggagagccggcctccatctcctgcaggtctagtcagagcctcctgcatagtaatggatacaactttttggattggtacctgcagaagccagggcagtctccacagctcctgatctatttgggttctaatcgggcctccggggtccctgacaggttcagtggcagtggatcaggcacagattttacactgaaattcagcagagtggaggctgaggatgttggggtttattactgcatgcaaactctacaaactccgtggacgttcggccaagggaccaaggtggaaatcaaacga

SEQ ID NO: 344 - protein, 113 aa, Artificial Sequence
  Synthetic
DIQMTQSPLSLPVTPGEPASISCRSSQSLLHSNGYNFLDWYLQKPGQSPQLLIYLGSNRASGVPDRFSGSGSGTDFTLKFSRVEAEDVGVYYCMQTLQTPWTFGQGTKVEIKR

SEQ ID NO: 345 - DNA, 381 bp, Artificial Sequence
  Synthetic
gaggtgcagctggtgcagtctgggggaggcttggtcaagcctggagggtccctgacactctcctgtgcagcctctggattcaccttcagtgactactacatgaactggatccgccaggctccagggaaggggctggagtgggtttcatacattagtactggtggtagtaccatatactacgcagactctgtgaagggccgattcaccatctccagggacaacgccaaaaactcactatatctgcaaatgaacagcctgaaagccgacgacccggccgtatattactgtgccagaggcgttgactccgatgactacgaggatttctactcctattacgatttggacgtctggggccaagggaccacggtcaccgtctcctca

SEQ ID NO: 346 - protein, 127 aa, Artificial Sequence
  Synthetic
EVQLVQSGGGLVKPGGSLTLSCAASGFTFSDYYMNWIRQAPGKGLEWVSYISTGGSTIYYADSVKGRFTISRDNAKNSLYLQMNSLKADDPAVYYCARGVDSDDYEDFYSYYDLDVWGQGTTVTVSS

SEQ ID NO: 347 - DNA, 324 bp, Artificial Sequence
  Synthetic
gacatccagatgacccagtctccatcctcactgtctgcatctgtaggagacagagtcaccatcacttgtcgggcgagtcagggcattagcaattatttagcctggtttcagcagaaaccagggaaagcccctaagtccctgatctatgctgcatccagtttgcacagtggggtcccatcaaagttcagcggcagtggatctgggacagatttcactctcaccatcagcagcctgcagcctgaagattttgcaacttattactgccaacagtataatagttaccctctcactttcggcggagggaccaaggtggaaatcaaacga

SEQ ID NO: 348 - protein, 108 aa, Artificial Sequence
  Synthetic
DIQMTQSPSSLSASVGDRVTITCRASQGISNYLAWFQQKPGKAPKSLIYAASSLHSGVPSKFSGSGSGTDFTLTISSLQPEDFATYYCQQYNSYPLTFGGGTKVEIKR

SEQ ID NO: 349 - DNA, 375 bp, Artificial Sequence
  Synthetic
caggtgcagctggtgcagtctggagctgaggtgaagaagcccggggcctcagtgaaggtctcctgcaaggcttctggttacacgtttagcaactatggtatcagctgggtgcgacaggcccctggacaagggcttgagtggatgggatggatcaacacttacaatggtgacacaaactatgcacaggagctccagggcagagtcaccatgaccacagacacatccacgaacacagcctacatggagatgaggagcctgagatctgacgacacggccgtgtattattgtgtgagagttgtagtagtaccagctgacggccactactactacggtatggacgtctggggccaagggaccacggtcaccgtctcctca

SEQ ID NO: 350 - protein, 125 aa, Artificial Sequence
  Synthetic
QVQLVQSGAEVKKPGASVKVSCKASGYTFSNYGISWVRQAPGQGLEWMGWINTYNGDTNYAQELQGRVTMTTDTSTNTAYMEMRSLRSDDTAVYYCVRVVVVPADGHYYYGMDVWGQGTTVTVSS

SEQ ID NO: 351 - DNA, 324 bp, Artificial Sequence
  Synthetic
gacatccagatgacccagtctccatccttcctgtctgcatctgtaggagacagagtcaccatcacttgctgggccagtcagggcagtggcagttatttagcctggtatcagcaaaaaccagggaaagcccctaagctcctgatctatgctgcatccactttacaaagtggggtcccatcaaggttcagcggcagtggatctgggacagaattcactctcacaatcagcagcctgcagcctgaagattttgcaacttattactgtcaacagcttaataattacctatttattttcggccctgggaccaaggtggaaatcaaacga

SEQ ID NO: 352 - protein, 108 aa, Artificial Sequence
  Synthetic
DIQMTQSPSFLSASVGDRVTITCWASQGSGSYLAWYQQKPGKAPKLLIYAASTLQSGVPSRFSGSGSGTEFTLTISSLQPEDFATYYCQQLNNYLFIFGPGTKVEIKR

SEQ ID NO: 353 - DNA, 372 bp, Artificial Sequence
  Synthetic
caggtgcagctggtgcagtctgggggaggcgtggtccagcctgggaggtccctgcgactctcctgtgaagcgtctggattcaccatcagtagctatggcatgcactgggtccgccaggctccaggcaaggggctggagtgggtggcagttatttggtatgatggaagtaataaatactatgcagactccgtgaagggccgattcaccatctccagagacaagtccaggaatacgctgtatctgcaaatgaacagcctgagagccgaggatacggctgtgtattactgtgcgagagataactggaactacgaggactattactactacggtatggacgtctggggccaagggaccacggtcaccgtctcctca

SEQ ID NO: 354 - protein, 124 aa, Artificial Sequence
  Synthetic
QVQLVQSGGGVVQPGRSLRLSCEASGFTISSYGMHWVRQAPGKGLEWVAVIWYDGSNKYYADSVKGRFTISRDKSRNTLYLQMNSLRAEDTAVYYCARDNWNYEDYYYYGMDVWGQGTTVTVSS

SEQ ID NO: 355 - DNA, 324 bp, Artificial Sequence
  Synthetic
gacatccagatgacccagtctccatcctcactgtctgcatctgtaggagacagagtcaccatcacttgtcgggcgagtcagggcattaacaattttttagcctggtttcagcagaaaccaggaaaagcccctaagtccctgatctatgctgcatcccgtttacaaagtggggtcccatcaaaattcagcggcagtggatctgggacagatttcactctcaccatcagcagcctgcagcctgaagattttgcaacttattactgcctacagtataatagttattttcggacgttcggccaagggaccaaggtggaaatcaaacga

SEQ ID NO: 356 - protein, 108 aa, Artificial Sequence
  Synthetic
DIQMTQSPSSLSASVGDRVTITCRASQGINNFLAWFQQKPGKAPKSLIYAASRLQSGVPSKFSGSGSGTDFTLTISSLQPEDFATYYCLQYNSYFRTFGQGTKVEIKR

SEQ ID NO: 357 - DNA, 381 bp, Artificial Sequence
  Synthetic
caggtgcagctggtgcagtctgggggaggcttggtcaagcctggagggtccctgagactctcctgtgcagcctctggattcaccttcagtgactactacatgaactggatccgccaggctccagggaaggggctggagtgggtttcatacattagtactggtggtagtaccatatactacgcagactctgtgaagggccgattcaccatctccagggacaacgccaagaactcactgtatctgcaaatgaacagcctgagagccgaggacacggccctatattactgtgcgagaggggttgactccgatgactacgaagattactactcctactacgatatggacgtctggggccaagggaccacggtcaccgtctcctca

SEQ ID NO: 358 - protein, 127 aa, Artificial Sequence
  Synthetic
QVQLVQSGGGLVKPGGSLRLSCAASGFTFSDYYMNWIRQAPGKGLEWVSYISTGGSTIYYADSVKGRFTISRDNAKNSLYLQMNSLRAEDTALYYCARGVDSDDYEDYYSYYDMDVWGQGTTVTVSS

SEQ ID NO: 359 - DNA, 324 bp, Artificial Sequence
  Synthetic
gacatccagatgacccagtctccatcctcactgtctgcatctgtaggagacagagtcaccatcacttgtcgggcgagtcagggcattagcaattatttagcctggtttcagcagaaaccagggaaagcccctaagtccctgatctatgctgcatccagtttgcacagtggggtcccatcaaagttcagcggcagtggatctgggacagatttcactctcaccatcagcagcctgcaacctgaagattttgcaacttattactgcctacagtataatagttaccctctcactttcggcggagggaccaaggtggaaatcaaacga

SEQ ID NO: 360 - protein, 108 aa, Artificial Sequence
  Synthetic
DIQMTQSPSSLSASVGDRVTITCRASQGISNYLAWFQQKPGKAPKSLIYAASSLHSGVPSKFSGSGSGTDFTLTISSLQPEDFATYYCLQYNSYPLTFGGGTKVEIKR

SEQ ID NO: 361 - DNA, 381 bp, Artificial Sequence
  Synthetic
gaggtgcagctggtggagtctgggggaggcttggtcaagcctggagggtccctgagactctcctgtgcagcctctggattcaccttcagtgactactacatgaactggatccgccaggctccagggaaggggctggagtgggtttcatacattagtactggtggtagtaccatatactacgcagactctgtgaagggccgattcaccatctccagggacaacgccaagaactcactatatctgcaaatgaacagcctgagagccgacgacacggccgtatattactgtgcgagaggagttgactccgatgactacgaggatttctactcctactacgatttggacgtctggggccaaggtaccacggtcaccgtctcctca

SEQ ID NO: 362 - protein, 127 aa, Artificial Sequence
  Synthetic
EVQLVESGGGLVKPGGSLRLSCAASGFTFSDYYMNWIRQAPGKGLEWVSYISTGGSTIYYADSVKGRFTISRDNAKNSLYLQMNSLRADDTAVYYCARGVDSDDYEDFYSYYDLDVWGQGTTVTVSS

SEQ ID NO: 363 - DNA, 324 bp, Artificial Sequence
  Synthetic
gacatccagatgacccagtctccatcctcactgtctgcatctgtaggagacagagtcaccatcacttgtcgggcgagtcagggcattagcaattatttagcctggtttcagcagaaaccagggaaagcccctaagtccctgatctatgctgcatccagtttgcacagtggggtcccatcaaagttcagcggcagtggatctgggacagatttcactctcaccatcagcagcctgcagcctgaagattttgcaacttattactgccaacagtataatagttaccctctcactttcggcggagggaccaaggtggagatcaaacga

SEQ ID NO: 364 - protein, 108 aa, Artificial Sequence; identical to SEQ ID NO: 348
  Synthetic

SEQ ID NO: 365 - DNA, 381 bp, Artificial Sequence
  Synthetic
caggtgcagctggtggagtctgggggaggcttggtcaagcctggagggtccctgagactctcctgtgcagcctctggattcaccttcagtgactattacatgaattggatccgccaggctccagggaaggggctggagtgggtttcatacattagtactagtggtagtaccatatactacgcagactctgtgaagggccgattcaccatctccagggacaacgccaagaactcactatatctgcaaatgaacaccctgagagccgaggacacggccgtgtattactgtgcgagaggggttgactccagtgactacgaggattactactcctactacgatttggacgtctggggccaagggaccacggtcaccgtctcctca

SEQ ID NO: 366 - protein, 127 aa, Artificial Sequence
  Synthetic
QVQLVESGGGLVKPGGSLRLSCAASGFTFSDYYMNWIRQAPGKGLEWVSYISTSGSTIYYADSVKGRFTISRDNAKNSLYLQMNTLRAEDTAVYYCARGVDSSDYEDYYSYYDLDVWGQGTTVTVSS

SEQ ID NO: 367 - DNA, 324 bp, Artificial Sequence
  Synthetic
gacatccagatgacccagtctccatcctcactgtctgcatctgtaggagacagagtcaccatcacttgtcgggcgagtcaggacattagcaattatttagcctggtttcagcagaaaccagggaaagcccctaagtccctgatctatgctgcatccagtttgcaaagtggggtcccatcaaagttcagcggcagtggatctgggacagatttcactctcaccatcagcagcctgcagcctgaagattttgcaacttattactgccaccagtataatagttaccctctcactttcggcggagggaccaaggtggaaatcaaacga

SEQ ID NO: 368 - protein, 108 aa, Artificial Sequence
  Synthetic
DIQMTQSPSSLSASVGDRVTITCRASQDISNYLAWFQQKPGKAPKSLIYAASSLQSGVPSKFSGSGSGTDFTLTISSLQPEDFATYYCHQYNSYPLTFGGGTKVEIKR

SEQ ID NO: 369 - DNA, 366 bp, Artificial Sequence
  Synthetic
caggtgcagctggtgcagtctgggggaggcttggtaaagcctggggggtcccttagactctcctgtgcagcctctggattcactttcagtgacgcctggatgacttgggtccgccaggctccaggtaaggggctggagtggattggccgtattaaaagcaaaactgatggtgggacaacagactacgctgcacccgtgaaaggcagattcaccatttcaagagatgattcaaaaaacacgctgtatctgcaaatgaacagcctgaaaaccgaggacacagccgcatattactgtttcacagacgatttttggagtggggattatacgcactgctggggccagggaaccctggtcaccgtctcctca

SEQ ID NO: 370 - protein, 122 aa, Artificial Sequence
  Synthetic
QVQLVQSGGGLVKPGGSLRLSCAASGFTFSDAWMTWVRQAPGKGLEWIGRIKSKTDGGTTDYAAPVKGRFTISRDDSKNTLYLQMNSLKTEDTAAYYCFTDDFWSGDYTHCWGQGTLVTVSS

SEQ ID NO: 371 - DNA, 339 bp, Artificial Sequence
  Synthetic
gacatccagatgacccagtctccactctccctgcccgtcacccctggagagccggcctccatctcctgcaggtctagtcagagcctcctgcatagtaatggatacaactttttggattggtacctgcagaagccagggcagtctccacagctcctgatctatttgggttctaatcgggcctccggggtccctgacaggttcagtggcagtggatcaggcacagattttacactgaaattcagcagagtggaggctgaggatgttggggtttattactgcatgcaaactctacaaactccgtggacgttcggccaagggaccaaggtggagatcaaacga

SEQ ID NO: 372 - protein, 113 aa, Artificial Sequence; identical to SEQ ID NO: 344
  Synthetic

SEQ ID NO: 373 - DNA, 366 bp, Artificial Sequence; identical to SEQ ID NO: 369
  Synthetic

SEQ ID NO: 374 - protein, 122 aa, Artificial Sequence; identical to SEQ ID NO: 370
  Synthetic

SEQ ID NO: 375 - DNA, 339 bp, Artificial Sequence
  Synthetic
gacatccagttgacccagtctccactctccctgcccgtcacccctggagagccggcctccatctcctgcaggtctagtcagagcctcctgcatagtaatggatacaactttttggattggtacctgcagaagccagggcagtctccacagctcctgatctatttgggttctaatcgggcctccggggtccctgacaggttcagtggcagtggatcaggcacagattttacactgaaattcagcagagtggaggctgaggatgttggactttattactgcatgcaaactctacaaactccgtggacgttcggccaagggaccaaggtggagatcaaacga

SEQ ID NO: 376 - protein, 113 aa, Artificial Sequence
  Synthetic
DIQLTQSPLSLPVTPGEPASISCRSSQSLLHSNGYNFLDWYLQKPGQSPQLLIYLGSNRASGVPDRFSGSGSGTDFTLKFSRVEAEDVGLYYCMQTLQTPWTFGQGTKVEIKR

SEQ ID NO: 377 - DNA, 360 bp, Artificial Sequence
  Synthetic
caggtgcagctggtggagtctgggggagacttggtacagcctggggggtccctgagactctcctgtgcagcctctggattcacctttagcagctatgccatgagttgggtccgccaggctccagggaaggggctggaatgggtctcagctattagtggtagtggtgattacacatactacgcagactccgtgaagggccggttcaccatctccagagacaattccaagaacacgctgtatctgcaaatgaacagcctgagagccgaggacacggccgtatattactgtgcgaaatacagttatggcctctactactacttcgatctctggggccgtggcaccacggtcaccgtctcctca

SEQ ID NO: 378 - protein, 120 aa, Artificial Sequence
  Synthetic
QVQLVESGGDLVQPGGSLRLSCAASGFTFSSYAMSWVRQAPGKGLEWVSAISGSGDYTYYADSVKGRFTISRDNSKNTLYLQMNSLRAEDTAVYYCAKYSYGLYYYFDLWGRGTTVTVSS

SEQ ID NO: 379 - DNA, 342 bp, Artificial Sequence
  Synthetic
gacatccagatgacccagtctccagactccctggctgtgtctctgggcgagagggccaccatcaactgcaagtccagccagagtgttttatacagttccaacaataagaactatttagcttggtaccagcagaaaccaggacagcctcctaagttgctcttttactgggcatctgcccgggaatccggggtccctgaccgcttcagtggcagcgggtctgggacagatttcactctcaccatcagcagcctgcaggctgaagatgtggcagtttattactgtcaccaatcgtataatattccgtacacttttggccaggggaccaaggtggaaatcaaacga

SEQ ID NO: 380 - protein, 114 aa, Artificial Sequence
  Synthetic
DIQMTQSPDSLAVSLGERATINCKSSQSVLYSSNNKNYLAWYQQKPGQPPKLLFYWASARESGVPDRFSGSGSGTDFTLTISSLQAEDVAVYYCHQSYNIPYTFGQGTKVEIKR

SEQ ID NO: 381 - DNA, 381 bp, Artificial Sequence
  Synthetic
caggtgcagctgctgcagtctgggggaggcttggtcaagcctggagggtccctgagactctcctgtgcagcctctggattcaccttcagtgactactacatgaactggatccgccaggctccagggaaggggctggagtgggtttcatacattagtactggtggtagtaccatatactacgcagactctgtgaagggccgattcaccatctccagggacaacgccaaaaactcactatatctgcaaatgaacagcctgagagccgacgacacggccgtatattactgtgcgagaggcgttgactccgatgactacgaggatttctactcctattacgatttggacgtctggggccaagggaccacggtcaccgtctcctca

SEQ ID NO: 382 - protein, 127 aa, Artificial Sequence
  Synthetic
QVQLLQSGGGLVKPGGSLRLSCAASGFTFSDYYMNWIRQAPGKGLEWVSYISTGGSTIYYADSVKGRFTISRDNAKNSLYLQMNSLRADDTAVYYCARGVDSDDYEDFYSYYDLDVWGQGTTVTVSS

SEQ ID NO: 383 - DNA, 324 bp, Artificial Sequence
  Synthetic
gacatccagatgacccagtctccatcctcactgtctgcatctgtaggagacagagtcaccatcacttgtcgggcgagtcagggcattagcaattatttagcctggtttcagcagaaaccagggaaagcccctaagtccctgatctatgctgcatccagtttgcacagtggggtcccatcaaagttcagcggcagtggatctgggacagatttcactctcaccatcagcagcctgcagcctgaagattttgcaacttattactgccaacagtataatagttaccctctcactttcggcggagggaccaagctggagatcaaacga

SEQ ID NO: 384 - protein, 108 aa, Artificial Sequence
  Synthetic
DIQMTQSPSSLSASVGDRVTITCRASQGISNYLAWFQQKPGKAPKSLIYAASSLHSGVPSKFSGSGSGTDFTLTISSLQPEDFATYYCQQYNSYPLTFGGGTKLEIKR

SEQ ID NO: 385 - DNA, 381 bp, Artificial Sequence
  Synthetic
caggtgcagctggtgcagtctgggggaggcttggtcaagcctggagggtccctgagactctcctgtgcagcctctggattcaccttcagtgactactacatgaattggatccgccaggctccagggaaggggctggagtgggtttcatacattagtactagtggtagtaccatatactacgcggactctgtgaagggccgattcaccatctccagggacaacgccaagaactcactgtatctgcaaatgaccagcctgagagccgaggacacggccgtgtattactgtgcgagaggggttgactccagtgactacgaggattactactcctactacgatatggacgtctggggccaagggaccacggtcaccgtctcctca

SEQ ID NO: 386 - protein, 127 aa, Artificial Sequence
  Synthetic
QVQLVQSGGGLVKPGGSLRLSCAASGFTFSDYYMNWIRQAPGKGLEWVSYISTSGSTIYYADSVKGRFTISRDNAKNSLYLQMTSLRAEDTAVYYCARGVDSSDYEDYYSYYDMDVWGQGTTVTVSS

SEQ ID NO: 387 - DNA, 324 bp, Artificial Sequence; identical to SEQ ID NO: 367
  Synthetic

SEQ ID NO: 388 - protein, 108 aa, Artificial Sequence; identical to SEQ ID NO: 368
  Synthetic

SEQ ID NO: 389 - DNA, 381 bp, Artificial Sequence
  Synthetic
caggtgcagctggtacagtctgggggaggcttggtcaagcctggagggtccctgagactctcctgtgcagcctctggattcaccttcagtgactactacatgaactggatccgccaggctccagggaaggggctggagtgggtttcatacattagtactggtggtagtaccatatactacgcagactctgtgaagggccgattcaccatctccagggacaacgccaagaactcactgtatctgcaaatgaacagcctgagagccgaggacacggccctatattactgtgcgagaggggttgactccgatgactacgaagattactactcctactacgatatggacgtctggggccaagggaccacggtcaccgtctcttca

SEQ ID NO: 390 - protein, 127 aa, Artificial Sequence; identical to SEQ ID NO: 358
  Synthetic

SEQ ID NO: 391 - DNA, 324 bp, Artificial Sequence; identical to SEQ ID NO: 359
  Synthetic

SEQ ID NO: 392 - protein, 108 aa, Artificial Sequence; identical to SEQ ID NO: 360
  Synthetic

SEQ ID NO: 393 - DNA, 381 bp, Artificial Sequence
  Synthetic
caggtgcagctggtgcagtctgggggaggcttggtcaagcctggagggtccctgagactctcctgtgcagcctctggattcaccttcagtgactactacatgaactggatccgccaggctccagggaagggactggagtgggtttcatacattagtactggtggtactaccatatactacgcagactctgtgaagggccgattcaccatctccagggacaacgccaagaactcactgtatctgcaaatgaacagcctgagagccgacgacacggccgtatattactgtgcgagaggagttgactccgatgactacgaggatttctactcctactacgatttggacgtctggggccaagggaccacggtcaccgtctcctca

SEQ ID NO: 394 - protein, 127 aa, Artificial Sequence
  Synthetic
QVQLVQSGGGLVKPGGSLRLSCAASGFTFSDYYMNWIRQAPGKGLEWVSYISTGGTTIYYADSVKGRFTISRDNAKNSLYLQMNSLRADDTAVYYCARGVDSDDYEDFYSYYDLDVWGQGTTVTVSS

SEQ ID NO: 395 - DNA, 324 bp, Artificial Sequence
  Synthetic
gacatccagatgacccagtctccatcctcagtgtctgcatctgtaggagacagagtcaccatcacttgtcgggcgagtcagggcattagtaattatttagcctggtttcagcagaaaccagggaaagcccctaagtccctgatctatgctgcatccagtttgcacagtggggtcccatcaaagttcagcggcagtggatctgggacagacttcactctcaccatcagcagcctgcagcctgaagattttgcaacttattactgccaacagtataatagttaccctctcactttcggcggagggaccaaggtggaaatcaaacga

SEQ ID NO: 396 - protein, 108 aa, Artificial Sequence
  Synthetic
DIQMTQSPSSVSASVGDRVTITCRASQGISNYLAWFQQKPGKAPKSLIYAASSLHSGVPSKFSGSGSGTDFTLTISSLQPEDFATYYCQQYNSYPLTFGGGTKVEIKR

SEQ ID NO: 397 - DNA, 366 bp, Artificial Sequence
  Synthetic
gaggtgcagctggtgcagtctgggggaggcttggtaaagcctggggggtcccttagactctcctgtgcagcctctggattcactttcagtaacgcctggatgacctgggtccgccaggctccagggaaggggctggagtgggttggccgtattaaaagcaaaactgatggtgggacaacagactacgctgcacccgtgaaaggcagattcaccatttcaagagatgattcaaaaaacacgctgtatctgcaaatgaacagcctgaaaaccgaggacacagccgtatattactgtctcacagacgatttttggagtgaatattatacacactgctggggccagggaaccctggtcaccgtctcctca

SEQ ID NO: 398 - protein, 122 aa, Artificial Sequence
  Synthetic
EVQLVQSGGGLVKPGGSLRLSCAASGFTFSNAWMTWVRQAPGKGLEWVGRIKSKTDGGTTDYAAPVKGRFTISRDDSKNTLYLQMNSLKTEDTAVYYCLTDDFWSEYYTHCWGQGTLVTVSS

SEQ ID NO: 399 - DNA, 339 bp, Artificial Sequence
  Synthetic
gacatccagatgacccagtctccactctccctgcccgtcacccctggagagccggcctccatctcctgcaggtctagtcagagcctcctgcatagtaatggatacaactttttggattggtatctgcagaagccagggcagtctccacagctcctgatctatttgggttctaatcgggcctccggggtccctgacaggttcagtggcagtggatcaggcacagattttacactgaaattcagcagagtggaggctgaggatgttggggtttattactgcatgcaaactctacaaactccgtggacgttcggccaagggaccaaggtggagatcaaacga

SEQ ID NO: 400 - protein, 113 aa, Artificial Sequence; identical to SEQ ID NO: 344
  Synthetic

SEQ ID NO: 401 - DNA, 381 bp, Artificial Sequence
  Synthetic
gaggtgcagctggtgcagtctgggggaggcttggtcaagcctggagggtccctgagactctcctgtgcagcctctggagtcaccttcagtgactactacatgacctggatccgccaggctccagggaagggcctggagtgggtttcatacattagtactagtggtcgtaccatatactacgcagactctgtgaagggccgattcaccatctccagggacaacgctaagaactcactgtatctgcaaatgaacaacctgagagccgaggacacggccgtatattactgtgcgagaggggttgactccgatgactacgaggatttctactcctactacgatatggacgtctggggccaagggaccacggtcaccgtctcctca

SEQ ID NO: 402 - protein, 127 aa, Artificial Sequence
  Synthetic
EVQLVQSGGGLVKPGGSLRLSCAASGVTFSDYYMTWIRQAPGKGLEWVSYISTSGRTIYYADSVKGRFTISRDNAKNSLYLQMNNLRAEDTAVYYCARGVDSDDYEDFYSYYDMDVWGQGTTVTVSS

SEQ ID NO: 403 - DNA, 324 bp, Artificial Sequence
  Synthetic
gacatccagatgacccagtctccatcctcactgtctgcatctgtaggagacagagtcaccatcacttgtcgggcgagtcagggcattagcaattatttagcctggtttcagcagaaaccagggaaagcccctaagtccctgatctatgctgcatccagtttgcaaagtggggtcccatcaaagttcagcggcagtggatctgggacagatttcactctcaccatcagcagcctgcagcctgaagattttgcaacttattactgccaacagtataatagttaccctctcactttcggcggagggaccaaggtggaaatcaaacga

SEQ ID NO: 404 - protein, 108 aa, Artificial Sequence
  Synthetic
DIQMTQSPSSLSASVGDRVTITCRASQGISNYLAWFQQKPGKAPKSLIYAASSLQSGVPSKFSGSGSGTDFTLTISSLQPEDFATYYCQQYNSYPLTFGGGTKVEIKR

SEQ ID NO: 405 - DNA, 378 bp, Artificial Sequence
  Synthetic
gaggtgcagctggtgcagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagagctcactgcatctgcaaatgaacagcctgagagccgaggacacggctgtgtattactgtgcgagagaaaccgttgattactatgataatagtgagtattcgtacggtatggacgtctggggccaagggaccacggtcaccgtctcctca

SEQ ID NO: 406 - protein, 126 aa, Artificial Sequence
  Synthetic
EVQLVQSGGGLVQPGGSLRLSCAASGFTFSSYWMSWVRQAPGKGLEWVANIKQDGSEKYYVDSVKGRFTISRDNAKSSLHLQMNSLRAEDTAVYYCARETVDYYDNSEYSYGMDVWGQGTTVTVSS

SEQ ID NO: 407 - DNA, 324 bp, Artificial Sequence
  Synthetic
gacatccagatgacccagtctccatcctccctgtctgcatctgtaggagacagagtcaccatcacttgccgggcaagtcagggcattagaaatgatttagactggtatcagcagaaaccagggaaagcccctaagcgcctgatctatactgcatccagtttgcaaagtggggtcccatcaaggttcagcggcagtggatctgggacagaattcactctcacaatcagcagcctgcagcctgaagattttgcaacttattactgtctacagtatagtaattaccctccgacgttcggccaagggaccaaggtggagatcaaacga

SEQ ID NO: 408 - protein, 108 aa, Artificial Sequence
  Synthetic
DIQMTQSPSSLSASVGDRVTITCRASQGIRNDLDWYQQKPGKAPKRLIYTASSLQSGVPSRFSGSGSGTEFTLTISSLQPEDFATYYCLQYSNYPPTFGQGTKVEIKR

SEQ ID NO: 409 - DNA, 381 bp, Artificial Sequence
  Synthetic
gaggtgcagctggtgcagtctgggggaggcttggtcaagcctggagggtccctgagactctcctgtgcagcctctggattcaccttcagtgactactacatgaactggatccgccaggctccagggaaggggctggagtgggtttcatacattagtactggtggtagtaccatatactacgcagactctgtgaagggccgattcaccatctccagggacaacgccaagaactcactatatctgcaaatgaacagcctgagagccgacgacacggccgtatattactgtgcgagaggagttgactccgatgactacgaagatttctactcctactacgatttggacgtctggggccaagggaccacggtcaccgtctcttca

SEQ ID NO: 410 - protein, 127 aa, Artificial Sequence
  Synthetic
EVQLVQSGGGLVKPGGSLRLSCAASGFTFSDYYMNWIRQAPGKGLEWVSYISTGGSTIYYADSVKGRFTISRDNAKNSLYLQMNSLRADDTAVYYCARGVDSDDYEDFYSYYDLDVWGQGTTVTVSS

SEQ ID NO: 411 - DNA, 324 bp, Artificial Sequence
  Synthetic
gacatccagatgacccagtctccatcctcactgtctgcatctgtaggagacagagtcaccatcacttgtcgggcgagtcagggcattagcaattatttagcctggtttcagcagaaaccagggaaagcccctaagtccctgatctatgctgcatccagtttgcacagtggggtcccatcaaagttcagcggcagtggatctgggacagatttcactctcaccatcagcagcctgcagcctgaagattttgcaacttattactgccaacagtatgatagttaccctctcactttcggcggagggaccaaggtggaaatcaaacga

SEQ ID NO: 412 - protein, 108 aa, Artificial Sequence
  Synthetic
DIQMTQSPSSLSASVGDRVTITCRASQGISNYLAWFQQKPGKAPKSLIYAASSLHSGVPSKFSGSGSGTDFTLTISSLQPEDFATYYCQQYDSYPLTFGGGTKVEIKR

SEQ ID NO: 413 - DNA, 381 bp, Artificial Sequence
  Synthetic
gaagtgcagctggtgcagtctgggggaggcttggtcaagcctggagggtccctgagactctcctgtgcagcctctggagtcaccttcagtgactactacatgaattggatccgccaggctccagggaaggggctggagtgggtttcatacattagtactagtggtagtatcatatactacacagactctgtgaagggccgattcaccatctccagggacaacgccaagaactcactgtatctgcaaatgaacagcctgagagccgaggacacggccgtatattactgtgcgggaggggttgactccgatgactacgaggattactactcctactacgatatggacgtctggggccaagggaccatggtcaccgtctcttca

SEQ ID NO: 414 - protein, 127 aa, Artificial Sequence
  Synthetic
EVQLVQSGGGLVKPGGSLRLSCAASGVTFSDYYMNWIRQAPGKGLEWVSYISTSGSIIYYTDSVKGRFTISRDNAKNSLYLQMNSLRAEDTAVYYCAGGVDSDDYEDYYSYYDMDVWGQGTMVTVSS

SEQ ID NO: 415 - DNA, 324 bp, Artificial Sequence
  Synthetic
gacatccagatgacccagtctccatcctcactgtctgcatctgtaggagacagagtcaccatcacttgtcgggcgagtcagggcattaacaattatttagcctggtttcagcagaaaccagggaaagcccctaagtccctgatctatgctgcatccagtttgcaaagtggggtcccatcaaagttcagcggcagtggatctgggacagatttcactctcaccatcagcagcctgcagcctgaagattttgcaatttattactgccaacagtataatagttaccctctcactttcggcggagggaccaaggtggaaatcaaacga

SEQ ID NO: 416 - protein, 108 aa, Artificial Sequence
  Synthetic
DIQMTQSPSSLSASVGDRVTITCRASQGINNYLAWFQQKPGKAPKSLIYAASSLQSGVPSKFSGSGSGTDFTLTISSLQPEDFAIYYCQQYNSYPLTFGGGTKVEIKR

SEQ ID NO: 417 - DNA, 372 bp, Artificial Sequence
  Synthetic
caggtgcagctggtgcagtctgggggaggcgtggtccagcctgggaggtccctgcgactctcctgtgaagcgtctggattcaccatcagtagctatggcatgcactgggtccgccaggctccaggcaaggggctggagtgggtggcagctatatggtatgatggaaataataaatactatgcagactccgtgaagggccgattcaccatctccagagacaagtccaggaatacgctgtatctgcaaatgaacagcctgagagccgaggatacggctgtgtattactgtgcgagagataactggaactacgaggactactactactacggtatggacgtctggggccaagggaccacggtcaccgtctcctca

SEQ ID NO: 418 - protein, 124 aa, Artificial Sequence
  Synthetic
QVQLVQSGGGVVQPGRSLRLSCEASGFTISSYGMHWVRQAPGKGLEWVAAIWYDGNNKYYADSVKGRFTISRDKSRNTLYLQMNSLRAEDTAVYYCARDNWNYEDYYYYGMDVWGQGTTVTVSS

SEQ ID NO: 419 - DNA, 324 bp, Artificial Sequence
  Synthetic
gacatccagatgacccagtctccatcctcactgtctgcatctgtaggagacagagtcaccatcacttgtcgggcgagtcagggcattaacaattttttagcctggtttcagcagaaaccaggaaaagcccctaagtccctgatctatgctgcatccagtttacaaagtggggtcccatcaaaattcagcggcagtggatctgggacagatttcactctcaccatcagcagcctgcagcctgaagattttgcaacttattactgcctacaatatagtagttattttcggacgttcggccaagggaccaaggtggaaatcaaacga

SEQ ID NO: 420 - protein, 108 aa, Artificial Sequence
  Synthetic
DIQMTQSPSSLSASVGDRVTITCRASQGINNFLAWFQQKPGKAPKSLIYAASSLQSGVPSKFSGSGSGTDFTLTISSLQPEDFATYYCLQYSSYFRTFGQGTKVEIKR

SEQ ID NO: 421 - DNA, 360 bp, Artificial Sequence
  Synthetic
caggtgcagctggtgcagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaattaataaatactatgtagactccgtgaagggccgattcaccatctccagagacaattccaagaacacgctgtatctgcaaatgaacagcctgagaactgaggacacggctgtgtatttctgtgcgaaaggggactacggtgacttcgatgcttttgatatctggggccaagggacaatggtcaccgtctcctca

SEQ ID NO: 422 - protein, 120 aa, Artificial Sequence
  Synthetic
QVQLVQSGGGVVQPGRSLRLSCAASGFTFSSYGMHWVRQAPGKGLEWVAVISYDGINKYYVDSVKGRFTISRDNSKNTLYLQMNSLRTEDTAVYFCAKGDYGDFDAFDIWGQGTMVTVSS

SEQ ID NO: 423 - DNA, 342 bp, Artificial Sequence
  Synthetic
gccatccagatgacccagtctccagactccctggctgtgtctctgggcgagagggccaccatcaactgcaggtccagccagagtgttttatacagctccaccaataagaactacttagcttggtaccagcagaaaccaggacagcctcctaagctgctcatttactgggcatctacccgggattccggggtccctgaccgattcagtggcagcgggtctgggacagatttcactctcaccatcagcagcctgcaggctgaagatgtggcagtttattactgtcaacaatattatagtatttatcggacgttcggccaagggaccaaggtggaaatcaaacga

SEQ ID NO: 424 - protein, 114 aa, Artificial Sequence
  Synthetic
AIQMTQSPDSLAVSLGERATINCRSSQSVLYSSTNKNYLAWYQQKPGQPPKLLIYWASTRDSGVPDRFSGSGSGTDFTLTISSLQAEDVAVYYCQQYYSIYRTFGQGTKVEIKR

SEQ ID NO: 425 - DNA, 354 bp, Artificial Sequence
  Synthetic
caggtgcagctggtgcagtctgggggaggcgtggtccagcctgggaggtccctgagactctcctgtgcagcctctggattcaccttcagtagctatggcattcactgggtccgccaggctccaggcaaggggctggagtgggtggcagttatatcatatgatggaagtgataaaaagtatgcagactccgtgaagggccgaatcaccatctccagagacaattccaagaatacgctgtatctgcaaatgaacagcctgagagctgaggacacggctgtgtattactgtgcgaaaggggggagtgggagctcctttgactactggggccagggaatcctggtcaccgtctcctca

SEQ ID NO: 426 - protein, 118 aa, Artificial Sequence
  Synthetic
QVQLVQSGGGVVQPGRSLRLSCAASGFTFSSYGIHWVRQAPGKGLEWVAVISYDGSDKKYADSVKGRITISRDNSKNTLYLQMNSLRAEDTAVYYCAKGGSGSSFDYWGQGILVTVSS

SEQ ID NO: 427 - DNA, 342 bp, Artificial Sequence
  Synthetic
caggtgcagctggtgcagtctgggggaggcttggtacagtttggggggtccctgagactctcctgtgcagcttctggattcacctttagcagctatggtatgaactgggtccgccagactccagggaaggggctcgagtgggtctcggctattggtggaagtggtggtagcacatactacgcagactccgtgaagggccggttcaccatctccagagacaattccaagaacacgctgtatctgcaaatgactagcctgagagccgaggacacggccgtatattactgtgcgaaaggggcctacgatgtctggggccaagggaccacggtcaccgtctcctca

SEQ ID NO: 428 - protein, 114 aa, Artificial Sequence
  Synthetic
QVQLVQSGGGLVQFGGSLRLSCAASGFTFSSYGMNWVRQTPGKGLEWVSAIGGSGGSTYYADSVKGRFTISRDNSKNTLYLQMTSLRAEDTAVYYCAKGAYDVWGQGTTVTVSS

SEQ ID NO: 429 - DNA, 357 bp, Artificial Sequence
  Synthetic
caggtgcagctggtgcagtctgggggaggcttggtacagccgggggggtccctgagactctcctgtgcagcctctggattcaccttaagtagttatgccatgagctgggtccgccaggctccagggaaggggctggagtgggtctcaacttttagtggtagtggtataatatactatttagactccgtgaagggccggttcaccatctccagagacagttccaagaacacgctgtatctgcaaatgaacagcctgagagtcgaggacacggccgtattttactgtgcgaaagatcgtggagcagcagctggagcctttgactactggggccagggaaccctggtcaccgtctcctca

SEQ ID NO: 430 - protein, 119 aa, Artificial Sequence
  Synthetic
QVQLVQSGGGLVQPGGSLRLSCAASGFTLSSYAMSWVRQAPGKGLEWVSTFSGSGIIYYLDSVKGRFTISRDSSKNTLYLQMNSLRVEDTAVFYCAKDRGAAAGAFDYWGQGTLVTVSS

SEQ ID NO: 431 - DNA, 342 bp, Artificial Sequence
  Synthetic
aaggtgcagctgttggagtctgggggaggcttggtacagtttggggggtccctgaaactctcctgtgcagcttctggattcacctttaccagctatggtatgaactgggtccgccaaactccagggaaggggctcgagtgggtctcggctattggtggaagtggtggtagcacatactacgcagactccgtgaagggccggttcaccatctccagagacaattccaagaacacgctgtatctgcaaatgactagcctgagagccgaggacacggccgtatattactgtgcgaaaggggcctacgatgtctggggccaagggaccacggtcaccgtctcctca

SEQ ID NO: 432 - protein, 114 aa, Artificial Sequence
  Synthetic
KVQLLESGGGLVQFGGSLKLSCAASGFTFTSYGMNWVRQTPGKGLEWVSAIGGSGGSTYYADSVKGRFTISRDNSKNTLYLQMTSLRAEDTAVYYCAKGAYDVWGQGTTVTVSS

SEQ ID NO: 433 - DNA, 357 bp, Artificial Sequence
  Synthetic
caggtgcagctggtgcagtctgggggaggcttggtacagccgggggggtccctgagactctcctgtgcagcctctggattcaccttaagtagttatgccatgagctgggtccgccaggctccagggaagggactggagtgggtctcaactattagtggtagtggtataatatactacacagactccgtgaagggccggttcaccatctccagagacagttccaagaacacggtgtatctgcaaatgaccagcctgagagtcgaggacacggccgtatattactgtgcgaaagatcgtggagcagcagctggagcctttgactactggggccagggaaccctggtcaccgtctcctca

SEQ ID NO: 434 - protein, 119 aa, Artificial Sequence
  Synthetic
QVQLVQSGGGLVQPGGSLRLSCAASGFTLSSYAMSWVRQAPGKGLEWVSTISGSGIIYYTDSVKGRFTISRDSSKNTVYLQMTSLRVEDTAVYYCAKDRGAAAGAFDYWGQGTLVTVSS

SEQ ID NO: 435 - DNA, 357 bp, Artificial Sequence
  Synthetic
caggtgcagctggtggagtctgggggaggcttggtacagcctggggggtccctgagactctcctgtgcagcctctggattcaccttcagtagctacgacatgcactgggtccgccaagctacaggaaaaggtctggagtgggtctcagctattggtactgctggtgacacatactatccaggctccgtgaagggccgattcaccatctccagagaaaatgcctacaactccttgtatcttcaaatgaacagcctgagagccggggacacggctgtgtattactgtgcagccgagtatagcagctcgggaggggcttttgatatctggggccaagggacaatggtcaccgtctcttca

SEQ ID NO: 436 - protein, 119 aa, Artificial Sequence
  Synthetic
QVQLVESGGGLVQPGGSLRLSCAASGFTFSSYDMHWVRQATGKGLEWVSAIGTAGDTYYPGSVKGRFTISRENAYNSLYLQMNSLRAGDTAVYYCAAEYSSSGGAFDIWGQGTMVTVSS

SEQ ID NO: 437 - DNA, 342 bp, Artificial Sequence; identical to SEQ ID NO: 125
  Synthetic

SEQ ID NO: 438 - protein, 114 aa, Artificial Sequence; identical to SEQ ID NO: 126
  Synthetic

SEQ ID NO: 439 - DNA, 363 bp, Artificial Sequence
  Synthetic
caggtgcagctggtgcagtctgggggaggcgtggtccagcctgggaggtccctgagactctcctgtgcagcctctggattcaccttcagtagctatggcttgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaagcccatagcagtggcccggtactacggtatggacgtctggggccaagggaccacggtcaccgtctcctca

SEQ ID NO: 440 - protein, 121 aa, Artificial Sequence
  Synthetic
QVQLVQSGGGVVQPGRSLRLSCAASGFTFSSYGLHWVRQAPGKGLEWVAVISYDGSNKYYADSVKGRFTISRDNSKNTLYLQMNSLRAEDTAVYYCAKPIAVARYYGMDVWGQGTTVTVSS

SEQ ID NO: 441 - DNA, 354 bp, Artificial Sequence
  Synthetic
aaggtgcagctggtggagtctgggggaggcttggtcaagcctggggggtccctgagactctcctgtgcagcctctggattcaccttcagtgaccattacatgaactggatccgccaggctccagggaaggggctggagtgggtttcatactttagtagtaatgttaataccatatactacaccgactctgtgaagggccgattcaccatctccagggacaacgccaaaaactcactgtatctacaaatgaacagcctgagagccgaggacacggccgtatattactgtgcgaaaaggacaccagctggtccatttgactactggggccagggaaccctggtcaccgtctcctca

SEQ ID NO: 442 - protein, 118 aa, Artificial Sequence
  Synthetic
KVQLVESGGGLVKPGGSLRLSCAASGFTFSDHYMNWIRQAPGKGLEWVSYFSSNVNTIYYTDSVKGRFTISRDNAKNSLYLQMNSLRAEDTAVYYCAKRTPAGPFDYWGQGTLVTVSS

SEQ ID NO: 443 - DNA, 363 bp, Artificial Sequence
  Synthetic
gaggtgcagctggtgcagtctgggggaggcttggtacagcctggggggtccctgaaactctcctgtgcagcctctggattcacctttagcaactatgccatgagctgggtccgccaggctccagggaaggggctggagtgggtctcagctattagtggtgatggtggtaacacatactacccaaactccgtgaagggccggttcaccatctccagagacaattccaagaacacgctgtatctgcaaatgaacagcctgagagccgaggacacggccgtatattactgtgcaaaagattattgtaatagcacctactactacggagaggactggggccggggaaccacggtcaccgtctcctca

SEQ ID NO: 444 - protein, 121 aa, Artificial Sequence
  Synthetic
EVQLVQSGGGLVQPGGSLKLSCAASGFTFSNYAMSWVRQAPGKGLEWVSAISGDGGNTYYPNSVKGRFTISRDNSKNTLYLQMNSLRAEDTAVYYCAKDYCNSTYYYGEDWGRGTTVTVSS

SEQ ID NO: 445 - DNA, 342 bp, Artificial Sequence
  Synthetic
gaggtgcagctggtgcagtctgggggaggcttggtacagtttggggggtccctgagactctcctgtgcagcttctggattcacctttagcagctatggtatgaactgggtccgccagactccagggaaggggctcgagtgggtctcggctattggtggaagtggtggtagcacatactacgcagactccgtgaagggccggttcaccatctccagagacaattccaagaacacgctgtatctgcaaatgactagcctgagagccgaggacacggccgtatattactgtgcgaaaggggcctacgatgtctggggccaagggaccacggtcaccgtctcctca

SEQ ID NO: 446 - protein, 114 aa, Artificial Sequence
  Synthetic
EVQLVQSGGGLVQFGGSLRLSCAASGFTFSSYGMNWVRQTPGKGLEWVSAIGGSGGSTYYADSVKGRFTISRDNSKNTLYLQMTSLRAEDTAVYYCAKGAYDVWGQGTTVTVSS

SEQ ID NO: 447 - DNA, 342 bp, Artificial Sequence; identical to SEQ ID NO: 157
  Synthetic

SEQ ID NO: 448 - protein, 114 aa, Artificial Sequence; identical to SEQ ID NO: 158
  Synthetic

SEQ ID NO: 449 - DNA, 342 bp, Artificial Sequence
  Synthetic
gaggtgcagctggtggagtctgggggaggcttggtacagtttggggggtccctgagactctcctgtgcagcttctggattcacctttaccagctatggtatgaactgggtccgccagactccagggaaggggctcgagtgggtctcggctattggtggaagtggtggtagcacatactacgcagactccgtgaagggccggttcaccatctccagagacaattccaagaacacgctgtatctgcaaatgactagcctgagagccgaggacacggccgtatattactgtgcgaaaggggcctacgatgtctggggccaagggaccacggtcaccgtctcctca

SEQ ID NO: 450 - protein, 114 aa, Artificial Sequence
  Synthetic
EVQLVESGGGLVQFGGSLRLSCAASGFTFTSYGMNWVRQTPGKGLEWVSAIGGSGGSTYYADSVKGRFTISRDNSKNTLYLQMTSLRAEDTAVYYCAKGAYDVWGQGTTVTVSS

SEQ ID NO: 451 - DNA, 339 bp, Artificial Sequence
  Synthetic
caggtgcagctggtgcagtctgggggaggcttggtacagcctggggggtccctgagactctcctgtgcagcctctggattcacctttagcagctatgccatgagttgggtccgccaggctcccgggaagggactggagtgggtctcagttattaatcgtagtggtggtggtacatactacgcagactccgtgaagggccggttcaccatctccagagacaattccaagaacgcgctgtatctgcaaatgaacagcctgagaaccgaggacacggccgtatattactgtgcgaaagaggtggaggactggggccagggaaccctggtcaccgtctcctca

SEQ ID NO: 452 - protein, 113 aa, Artificial Sequence
  Synthetic
QVQLVQSGGGLVQPGGSLRLSCAASGFTFSSYAMSWVRQAPGKGLEWVSVINRSGGGTYYADSVKGRFTISRDNSKNALYLQMNSLRTEDTAVYYCAKEVEDWGQGTLVTVSS

SEQ ID NO: 453 - DNA, 342 bp, Artificial Sequence
  Synthetic
caggtgcagctggtgcagtctggagctgaggtgaagaagcctggggcctcagtgaaggtctcctgcaaggcttctggttacacctttaccagctatggtgtcagctgggtgcgacaggcccctgggcaagggcttgagtggatgggatggatcagcgcttacaatggtaacacaaactatgcacagaaactccagggcagagtcaccatgaccacagacacatccacgagcacagcctacatggagctgacgagcctgagatctgacgacacggccgtgtattactgtgcgagaaactggggagactactggggccagggaaccctggtcactgtctcctca

SEQ ID NO: 454 - protein, 114 aa, Artificial Sequence
  Synthetic
QVQLVQSGAEVKKPGASVKVSCKASGYTFTSYGVSWVRQAPGQGLEWMGWISAYNGNTNYAQKLQGRVTMTTDTSTSTAYMELTSLRSDDTAVYYCARNWGDYWGQGTLVTVSS

SEQ ID NO: 455 - DNA, 354 bp, Artificial Sequence
  Synthetic
caggtgcagctggtgcagtctgggggaggcgtggtccagcctgggaggtccctgagactctcctgtgcagcctctggattcaccttcagtagttatggcatgcactgggtccgccaggctccaggcaaggggctggagtgggtggcagttatatcatatgatggaagtaataaaaagtatgcagactccgtgaagggccgaatcaccatctctagagacaattccaagaatacgctgtatctgcaaatgaacagcctgagagctgaggacacggctgtgttttactgtgcgaaaggggggagtgggtactcctttgactactggggccagggaaccctggtcaccgtctcttca

SEQ ID NO: 456 - protein, 118 aa, Artificial Sequence
  Synthetic
QVQLVQSGGGVVQPGRSLRLSCAASGFTFSSYGMHWVRQAPGKGLEWVAVISYDGSNKKYADSVKGRITISRDNSKNTLYLQMNSLRAEDTAVFYCAKGGSGYSFDYWGQGTLVTVSS

SEQ ID NO: 457 - DNA, 354 bp, Artificial Sequence
  Synthetic
caagtgcagctggtggagtctgggggaggcttggtccagcctggggggtccctgagactctcctgtgcagcctctggattcactttcagcagctatgccatgagctgggtccgccaggctccaggcaaggggctggagtgggtgtcagctattatggatgatggaggtaatacatactacgcagactctgtgaagggccggttcaccatctccagagacaattccaagaacatgctgtatctgcaaatgaacagcctgagagccgaggacacggccgtatattactgtgcgagaggacaatttttgatgtggttcgacccctggggccagggaaccctggtcaccgtctcctca

SEQ ID NO: 458 - protein, 118 aa, Artificial Sequence
  Synthetic
QVQLVESGGGLVQPGGSLRLSCAASGFTFSSYAMSWVRQAPGKGLEWVSAIMDDGGNTYYADSVKGRFTISRDNSKNMLYLQMNSLRAEDTAVYYCARGQFLMWFDPWGQGTLVTVSS

SEQ ID NO: 459 - DNA, 396 bp, Artificial Sequence
  Synthetic
caggtgcagctggtgcagtctgggggaggcgtggtccagcctgggaggtccctgagactctcctgtgcagcctctggattcaccttcagtagctatggcatgcactgggtccgccaggctccaggcaaggggctggagtgggtggcatttatttcatatgatggaagtaataaattctatgcagactccgtgaagggccgactcaccatctccagggacaattccaagaacatgctgtatctgcaaatgaacagcctgagagctgaggacacggctgtgtattactgtgcgaaagggggtgtagtaataccaggtcctacacggtataactggaaccactactactactatggtatggacgtctggggccaagggaccacggtcaccgtctcctca

SEQ ID NO: 460 - protein, 132 aa, Artificial Sequence
  Synthetic
QVQLVQSGGGVVQPGRSLRLSCAASGFTFSSYGMHWVRQAPGKGLEWVAFISYDGSNKFYADSVKGRLTISRDNSKNMLYLQMNSLRAEDTAVYYCAKGGVVIPGPTRYNWNHYYYYGMDVWGQGTTVTVSS

SEQ ID NO: 461 - DNA, 354 bp, Artificial Sequence
  Synthetic
caggtgcagctggtggagtctgggggaggcgtggtccagcctgggaggtccctgagactctcctgtgcagcctctggattcaccttcagtagctatggcatgcactgggtccgccaggctccaggcaagggactggagtgggtggcagttatatcgtatgatggaagtgataaaaaatatgcagactctgtgaagggccgattcaccatcgccagagacaattccaaaagcacgctgcatctgcaaatgaacagcctgagagttgaggacacggctgtgttttattgtgtgagagggggcaggggatttgtttttgatatgtggggccaagggacaatggtcaccgtctcttca

SEQ ID NO: 462 - protein, 118 aa, Artificial Sequence
  Synthetic
QVQLVESGGGVVQPGRSLRLSCAASGFTFSSYGMHWVRQAPGKGLEWVAVISYDGSDKKYADSVKGRFTIARDNSKSTLHLQMNSLRVEDTAVFYCVRGGRGFVFDMWGQGTMVTVSS

SEQ ID NO: 463 - DNA, 348 bp, Artificial Sequence
  Synthetic
gaggtgcagctggtgcagtctgggggaggcttggttaagccgggggggtcccttagactctcctgtgcagcctctggattcaccttcagtaacgtctggatgagctgggtccgccaggctccagggcaggggctggagtgggttggccgtattaaaagcaaaattgatggtgggacaacagactacgctgcacccgtgaaaggcagattcaccatctcaagagatgattcaaaaaatacgctgtatctgcaaatgaacagcctgaaaaccgaggacacagccgtgtattactgtaccacagggggtgggacctactggggccagggaaccctggtcaccgtctcctca

SEQ ID NO: 464 - protein, 116 aa, Artificial Sequence
  Synthetic
EVQLVQSGGGLVKPGGSLRLSCAASGFTFSNVWMSWVRQAPGQGLEWVGRIKSKIDGGTTDYAAPVKGRFTISRDDSKNTLYLQMNSLKTEDTAVYYCTTGGGTYWGQGTLVTVSS

SEQ ID NO: 465 - DNA, 342 bp, Artificial Sequence
  Synthetic
caggtgcagctggtggagtctggagctgaggtgaagaagcctggggcctcagtgaaggtctcctgcaaggcttctggttacacctttaccagctatggtatcagctgggtgcgacaggcccctggacaagggcttgagtggatgggatggatcagcggttacaatggtaacacaaaatatgcacagaaggtccagggcagagtcaccatgaccacagacgcatccacgagcacagcctacatggagctgaggagcctgagatctgacgacacggccgtgtattactgtgcgagaaactggggagactactggggccagggaaccctggtcaccgtctcctca

SEQ ID NO: 466 - protein, 114 aa, Artificial Sequence
  Synthetic
QVQLVESGAEVKKPGASVKVSCKASGYTFTSYGISWVRQAPGQGLEWMGWISGYNGNTKYAQKVQGRVTMTTDASTSTAYMELRSLRSDDTAVYYCARNWGDYWGQGTLVTVSS

SEQ ID NO: 467 - DNA, 348 bp, Artificial Sequence
  Synthetic
caggtgcagctggtgcagtctgggggaggcttggttaagccgggggggtcccttagactctcctgtgcagcctctggattcaccttcagtaacgtctggatgagctgggtccgccaggctccagggcagggtctggagtgggttggccgtattaaaagcaaaattgatggtgggacaacagactacgctgcacccgtgaaaggcagattcttcatctcaagagatgattcaaaaaatacgctgtatctgcaaatgaatagcctgaaaaccgaggacacagccgtgtattactgtaccacagggggtgggacctactggggccagggaaccctggtcaccgtctcctca

SEQ ID NO: 468 - protein, 116 aa, Artificial Sequence
  Synthetic
QVQLVQSGGGLVKPGGSLRLSCAASGFTFSNVWMSWVRQAPGQGLEWVGRIKSKIDGGTTDYAAPVKGRFFISRDDSKNTLYLQMNSLKTEDTAVYYCTTGGGTYWGQGTLVTVSS

SEQ ID NO: 469 - DNA, 366 bp, Artificial Sequence
  Synthetic
caggtgcagctggtgcagtctggaactgacgtgaagaagccaggggcctcactgaaggtctcctgcgaggtttctggttacacctttgccaactatggtctcagctgggtgcgacaggcccctggacaagggcttgagtggatggggtggatcatcgcttacactactaacacaaactatgcacagaagctccaggacagagtcaccataaccacagacacatccacgagcacagcctacatggaactgaggagcctgagatctgacgacacggcggtttattactgtgcgagagtgtttagtggtaccaaccaccttaactactttgactactggggccagggaaccctggtcaccgtctcctca

SEQ ID NO: 470 - protein, 122 aa, Artificial Sequence
  Synthetic
QVQLVQSGTDVKKPGASLKVSCEVSGYTFANYGLSWVRQAPGQGLEWMGWIIAYTTNTNYAQKLQDRVTITTDTSTSTAYMELRSLRSDDTAVYYCARVFSGTNHLNYFDYWGQGTLVTVSS

SEQ ID NO: 471 - DNA, 351 bp, Artificial Sequence
  Synthetic
caggtgcagctggtgcagtctgggggaggcttggtacagcctggggggtccctgagactctcctgtgcagcctctggattcacctttagcagctatgtcatgagctgggtccgccagactccagggaagggactggagtgggtctcagctattcgtactagtggtggtggcacatactacgcagactccgtgaagggccggttcaccatctccagagacaattccaagagcacgctgtatctgcaaatgaacagcctgagagccgaggactcggccgtatattactgtgcgaaagatggctacggtgcctttgactactggggccagggaaccctggtcaccgtctcctca

SEQ ID NO: 472 - protein, 117 aa, Artificial Sequence
  Synthetic
QVQLVQSGGGLVQPGGSLRLSCAASGFTFSSYVMSWVRQTPGKGLEWVSAIRTSGGGTYYADSVKGRFTISRDNSKSTLYLQMNSLRAEDSAVYYCAKDGYGAFDYWGQGTLVTVSS

SEQ ID NO: 473 - DNA, 360 bp, Artificial Sequence
  Synthetic
caggtgcagctggtgcagtctggggctgacgtgaacaagcctggggcctcactgaaggtctcctgcgcagcttctggatacaccttcaccaattatgatatcaactgggtgccacaggccactggacaagggcttgagtggatgggatggatgaaccctaccagtggtaacacatgctattcacacaagttccagggcagagtcaccatgaccaggagcacctccataagcacagcctacatggagctgagcagcctgagatctgaggacacggccgtgtattactgtgcgagagatatagtgggagctcttgatgcttttgatatctggggccaagggacaatggtcaccgtctcttca

SEQ ID NO: 474 - protein, 120 aa, Artificial Sequence
  Synthetic
QVQLVQSGADVNKPGASLKVSCAASGYTFTNYDINWVPQATGQGLEWMGWMNPTSGNTCYSHKFQGRVTMTRSTSISTAYMELSSLRSEDTAVYYCARDIVGALDAFDIWGQGTMVTVSS

SEQ ID NO: 475 - DNA, 360 bp, Artificial Sequence
  Synthetic
caggtgcagctggtgcagtctgggggaggcttggtacagcctggggggtccctgagactctcctgtgcagcctctggcttcacctttagcagctatgccatgagctgggtccgccagggtccagggaaggggctggagtgggtctcagttattagtggtagtggtggtagcacatactacgcagactccgtgaagggccggttcaccatctccagagacaattccaagaacacgctgtatctgcaaatgaacagcctgagagccgaggacacggccgtatattactgtgcgaaacatataactggaattgcggacggtatggacgtctggggccaagggaccacggtcaccgtctcctca

SEQ ID NO: 476 - protein, 120 aa, Artificial Sequence
  Synthetic
QVQLVQSGGGLVQPGGSLRLSCAASGFTFSSYAMSWVRQGPGKGLEWVSVISGSGGSTYYADSVKGRFTISRDNSKNTLYLQMNSLRAEDTAVYYCAKHITGIADGMDVWGQGTTVTVSS

SEQ ID NO: 477 - DNA, 351 bp, Artificial Sequence
  Synthetic
caggtgcagctggtggagtctggggcaggcgtgatcaaccctggggcgtccctgatactctcctgtgcagcttctggatacaccttcactagctaccatattcactgggtgcgacaggcccctggccaggggctggagtggatgggatggataaaccataacggtggtgacaaaaactatgcacactattttcagggccgggtcaccttgaccagagacacttccaacaccacactctacctggaattgaacaggctgagatctgacgacacggctgtgtattactgtgcgaaagacgggatcggaaactttgactactggggccagggaaccctggtcaccgtctcctcc

SEQ ID NO: 478 - protein, 117 aa, Artificial Sequence
  Synthetic
QVQLVESGAGVINPGASLILSCAASGYTFTSYHIHWVRQAPGQGLEWMGWINHNGGDKNYAHYFQGRVTLTRDTSNTTLYLELNRLRSDDTAVYYCAKDGIGNFDYWGQGTLVTVSS

SEQ ID NO: 479 - DNA, 354 bp, Artificial Sequence
  Synthetic
caggtgcagctggtggagtctgggggaggcgtggtccagcctgggaggtccctgagactctcctgtgcagcctctggattcacgttcagtagctatggcatgcactgggtccgccaggccccaggcaaggggctggagtgggtggcagttatatcatatgatggaagtgataaaaaatatgcagactctgtgaagggccgattcaccatcgccagagacaattccaagagcacgctgcatctgcaaatgaacagcctgagagttgaggacacggctgtgttttattgtgcgagagggggcaggggatttgtttttgatatgtggggccaagggacaatggtcaccgtctcctca

SEQ ID NO: 480 - protein, 118 aa, Artificial Sequence
  Synthetic
QVQLVESGGGVVQPGRSLRLSCAASGFTFSSYGMHWVRQAPGKGLEWVAVISYDGSDKKYADSVKGRFTIARDNSKSTLHLQMNSLRVEDTAVFYCARGGRGFVFDMWGQGTMVTVSS

SEQ ID NO: 481 - DNA, 396 bp, Artificial Sequence
  Synthetic
caggtgcagctggtgcagtctgggggaggcgtggtccagcctgggaggtccctgagactctcctgtgcagcctctggattcaccttcagtagctatggcatgcactgggtccgccaggctccaggcaaggggctggagtgggcggcatttatttcatatgatggaagtaataaattctatgcagactccgtgaagggccgactcaccatctccagggacaattccaagaacattctgtatctgcaaatgaacagcctgagagctgaggacacggctgtatattactgtgcgaaagggggtgtagttgtaccaggtcctacacggtataactggaaccactactactactatggtatggacgtctggggccaagggaccacggtcaccgtctcctca

SEQ ID NO: 482 - protein, 132 aa, Artificial Sequence
  Synthetic
QVQLVQSGGGVVQPGRSLRLSCAASGFTFSSYGMHWVRQAPGKGLEWAAFISYDGSNKFYADSVKGRLTISRDNSKNILYLQMNSLRAEDTAVYYCAKGGVVVPGPTRYNWNHYYYYGMDVWGQGTTVTVSS

SEQ ID NO: 483 - DNA, 396 bp, Artificial Sequence; identical to SEQ ID NO: 201
  Synthetic

SEQ ID NO: 484 - protein, 132 aa, Artificial Sequence; identical to SEQ ID NO: 202
  Synthetic

SEQ ID NO: 485 - DNA, 396 bp, Artificial Sequence
  Synthetic
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcatttatttcatatgatggaggtaataaattctatgcagactccgtgaagggccgactcaccatctccagggacaattccaagaacattctgtatctgcaaatgaacagcctgacagctgaggacacggctgtgtattactgtgcgaaagggggtgtagttgtaccaggtcctacacggtataactggaaccactactactactatggtatggacgtctggggccaagggaccacggtcaccgtctcctca

SEQ ID NO: 486 - protein, 132 aa, Artificial Sequence
  Synthetic
QVQLVESGGGVVQPGRSLRLSCAASGFTFSSYGMHWVRQAPGKGLEWVAFISYDGGNKFYADSVKGRLTISRDNSKNILYLQMNSLTAEDTAVYYCAKGGVVVPGPTRYNWNHYYYYGMDVWGQGTTVTVSS

SEQ ID NO: 487 - DNA, 354 bp, Artificial Sequence
  Synthetic
caggtgcagctggtgcagtctgggggaggcgtggtccagcctgggaggtccctgagactctcctgtgcagcctctggattcaccttcagtaactatggcatgcactgggtccgccaggctccaggcaaggggctggagtggttggcagttatatcatatgatggcagtaataaacactatgtagactccgtgaagggccgattcaccatttccagggacaattccaagaatacgctgtatctgcaaatgaacagtctgagaactgaagacacggctgtgcattactgtgtgagagggggcagtggctggtcctttgactcctggggccagggaaccctggtcaccgtctcctca

SEQ ID NO: 488 - protein, 118 aa, Artificial Sequence
  Synthetic
QVQLVQSGGGVVQPGRSLRLSCAASGFTFSNYGMHWVRQAPGKGLEWLAVISYDGSNKHYVDSVKGRFTISRDNSKNTLYLQMNSLRTEDTAVHYCVRGGSGWSFDSWGQGTLVTVSS

SEQ ID NO: 489 - DNA, 354 bp, Artificial Sequence
  Synthetic
caggtgcagctggtggagtctgggggaggcgtggtccagcctgggaggtccctgagactctcctgtgcagcctctggattcaccttcagtgactatggcatgcactgggtccgccaggctccaggcaaggggctggagtgggtgtcagttatatcatatgatggaactaataaatactatgcagactccgtgaagggccgattcaccatctccagagacaattccaagaacacgctgtatctgcaaatgagcagcctgagacctgaggacacggctgtgtattactgtccgaaagggggcagtggctggtcctttgactactggggccagggaaccctggtcaccgtctcctca

SEQ ID NO: 490 - protein, 118 aa, Artificial Sequence
  Synthetic
QVQLVESGGGVVQPGRSLRLSCAASGFTFSDYGMHWVRQAPGKGLEWVSVISYDGTNKYYADSVKGRFTISRDNSKNTLYLQMSSLRPEDTAVYYCPKGGSGWSFDYWGQGTLVTVSS

SEQ ID NO: 491 - DNA, 354 bp, Artificial Sequence
  Synthetic
caggtgcagctggtgcagtctgggggaggcgtggtccagcctgggaggtccctgagactctcctgtgcagcctccggattcaccttcagtaactatggcatgcactgggtccgccaggctccaggccaggggctggagtggttggcggttatatcatatgatggcaataataaacactatgtagactccgtgaagggccgattcaccatttccagagacaattccaagagcacgctttttctgcaaatgaacagcctgagaactgaagacacgactgtgtattactgtgcgagagggggcagtggctggtcctttgactcctggggccagggaaccctggtcaccgtctcctca

SEQ ID NO: 492 - protein, 118 aa, Artificial Sequence
  Synthetic
QVQLVQSGGGVVQPGRSLRLSCAASGFTFSNYGMHWVRQAPGQGLEWLAVISYDGNNKHYVDSVKGRFTISRDNSKSTLFLQMNSLRTEDTTVYYCARGGSGWSFDSWGQGTLVTVSS

SEQ ID NO: 493 - DNA, 351 bp, Artificial Sequence
  Synthetic
caggtgcagctggtggagtctgggggaggcgtggtccagcctgggaggtccctgagactctcctgtgcagcctctggattcaccttcaatgactatggcatgcactggttccgccaggctccaggcaagggactggaatggttggcagttatatcatatgatggcaatgataaacagtatgaagactccgtgaagggccgattcaccatttccagagacaattccaagaacacactgtttctgcaaatgactagtctgagagctgaggacacggctatgtatttctgtgcaagagggggcagtggctggacctttgactcctggggccagggaaccctggtcacgtctccc

SEQ ID NO: 494 - protein, 117 aa, Artificial Sequence
  Synthetic
QVQLVESGGGVVQPGRSLRLSCAASGFTFNDYGMHWFRQAPGKGLEWLAVISYDGNDKQYEDSVKGRFTISRDNSKNTLFLQMTSLRAEDTAMYFCARGGSGWTFDSWGQGTLVTSP

SEQ ID NO: 495 - DNA, 348 bp, Artificial Sequence
  Synthetic
gaggtgcagctggtgcagtctgggggaggcttggtcaagcctggagggtccctgagactctcctgtgcagcctctggattcaccttcagtgactactacatgagctggatccgccaggctccagggaaggggctggagtgggtttcatgcataactagtagtggtagtaccaaaaaacacgcagactctgtgaagggccgattcaccatctccagggacaacgccaagaactcactgtatctgcaaatgaacagcctgagagccgaggacacggccgtgtattactgtgcgagagtttcgagaggctttgaccactggggccagggaaccctggtcaccgtctcctca

SEQ ID NO: 496 - protein, 116 aa, Artificial Sequence
  Synthetic
EVQLVQSGGGLVKPGGSLRLSCAASGFTFSDYYMSWIRQAPGKGLEWVSCITSSGSTKKHADSVKGRFTISRDNAKNSLYLQMNSLRAEDTAVYYCARVSRGFDHWGQGTLVTVSS

SEQ ID NO: 497 - DNA, 348 bp, Artificial Sequence
  Synthetic
caggtgcagctggtggagtctgggggaggcttggtcaagcctggagggtccctgagactctcctgtgcagcctctggattcaccttcagtgactactacatgagctggatccgccaggctccagggaaggggctggagtgggtttcatgcataactagtagtggtggtaccaaaaaatacgcagactctgtgaagggccgattcaccatctccagggacaacgccgagaactcactttatctgcaaatgaacagcctgagagccgaggacacggccgtgtattactgtgcgagagtttcgagaggctttgaccactggggccagggaaccctggtcaccgtctcctca

SEQ ID NO: 498 - protein, 116 aa, Artificial Sequence
  Synthetic
QVQLVESGGGLVKPGGSLRLSCAASGFTFSDYYMSWIRQAPGKGLEWVSCITSSGGTKKYADSVKGRFTISRDNAENSLYLQMNSLRAEDTAVYYCARVSRGFDHWGQGTLVTVSS

SEQ ID NO: 499 - DNA, 354 bp, Artificial Sequence
  Synthetic
caggtgcagctggtggagtctgggggaggcgtggtccagcctgggaggtccctgagactctcctgtgcagcctctggattcaccttcagtagctatggcatgcactgggtccgccaggctccaggcaaggggctggagtggttggcagttatatcatatgatggcactaataaacactatgtagactccgtgaagggccgattcaccatttccagagacaattccaagaacacggtgtatctgcaaatgaacagcctaagagctgaggacacggctttatattactgtgcgagagggggcagtggctggtcctttgactcctggggccagggaaccctggtcaccgtctcctca

SEQ ID NO: 500 - protein, 118 aa, Artificial Sequence
  Synthetic
QVQLVESGGGVVQPGRSLRLSCAASGFTFSSYGMHWVRQAPGKGLEWLAVISYDGTNKHYVDSVKGRFTISRDNSKNTVYLQMNSLRAEDTALYYCARGGSGWSFDSWGQGTLVTVSS

SEQ ID NO: 501 - DNA, 354 bp, Artificial Sequence
  Synthetic
caggtgcagctggtgcagtcggggggaggcgtggtccagcctgggaggtccctgagactctcctgtgtagcctctggattcaccttcaataactatggccttcactggttccgccaggctccaggcaagggcctggagtggttggcagttatatcatatgatggcaatgataaacactatgtagactacgtgaagggccgattcaccatttccagagacaattccagatacacactgaatctgcaaatgaacagcctgagaactgaggacacggctttgtattactgtgcgagagggggcagtggctggtcctttgactcctggggccagggaaccctggtcaccgtctcctca

SEQ ID NO: 502 - protein, 118 aa, Artificial Sequence
  Synthetic
QVQLVQSGGGVVQPGRSLRLSCVASGFTFNNYGLHWFRQAPGKGLEWLAVISYDGNDKHYVDYVKGRFTISRDNSRYTLNLQMNSLRTEDTALYYCARGGSGWSFDSWGQGTLVTVSS

SEQ ID NO: 503 - DNA, 378 bp, Artificial Sequence
  Synthetic
caggtgcagctggtggagtctgggggaggcgtggtccagcctgggaggtccctgaaactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcaagagatgaggggcgggggttcgggacgtactactactactacggtatggacgtctggggccaagggaccacggtcaccgtctcctca

SEQ ID NO: 504 - protein, 126 aa, Artificial Sequence
  Synthetic
QVQLVESGGGVVQPGRSLKLSCAASGFTFSSYGMHWVRQAPGKGLEWVAVIWYDGSNKYYADSVKGRFTISRDNSKNTLYLQMNSLRAEDTAVYYCARDEGRGFGTYYYYYGMDVWGQGTTVTVSS

SEQ ID NO: 505 - DNA, 354 bp, Artificial Sequence
  Synthetic
gaggtgcagctggtggagtctgggggaggtgtggtccagcctgggaggtccctgagactctcctgtgcagcctctggattcaccttcagaagttatggcatgcattgggtccgccaggctccaggcaaggggctggagtggttggcagttacatcatatgatggtaatagtcaacactatgtagactccgtgaagggccgattcaccatttccagagacaattccaagaacacgctgtatctgcaaatgaacagcctgagagctgaggacacggctgtgttttactgtgcgagagggggcagtggctggtcctttgactcctggggccagggaaccctggtcaccgtctcttca

SEQ ID NO: 506 - protein, 118 aa, Artificial Sequence
  Synthetic
EVQLVESGGGVVQPGRSLRLSCAASGFTFRSYGMHWVRQAPGKGLEWLAVTSYDGNSQHYVDSVKGRFTISRDNSKNTLYLQMNSLRAEDTAVFYCARGGSGWSFDSWGQGTLVTVSS

SEQ ID NO: 507 - DNA, 354 bp, Artificial Sequence
  Synthetic
gaggtgcagctggtggagtctgggggaggcgtggtccagcctgggaggtccctgagactctcctgtgcagcctctggattcaccttcagtagttatggcattcactgggtccgccaggctccaggcaaggggctggagtggttggcagttatatcatatgatggcagtaataaacactatgtagactccgtgaagggccgactcaccatttccagagacaattccaagaacacgctgtatctgcaaatgaacagcctgagagctgaggacacggctgtgtattactgtgcgagagggggccgtggctggtcctttgactcctggggccagggaaccacggtcaccgtctcctca

SEQ ID NO: 508 - protein, 118 aa, Artificial Sequence
  Synthetic
EVQLVESGGGVVQPGRSLRLSCAASGFTFSSYGIHWVRQAPGKGLEWLAVISYDGSNKHYVDSVKGRLTISRDNSKNTLYLQMNSLRAEDTAVYYCARGGRGWSFDSWGQGTTVTVSS

SEQ ID NO: 509 - DNA, 354 bp, Artificial Sequence
  Synthetic
caagtgcagctggtgcagtctgggggaggcgtggtccagcctgggaggtccctgagactctcctgtgcagcgtctggattcaccttcagtaactatggcatgcactgggtccgccaggctccaggcaaggggctggagtggttggcagttatatcatatgatggcagtaataaacactatgtagactccgtgaagggccgattcaccatttccagagacaattccaagaacacgctgtatctgcaaatgaacagcctgagagctgaggacacggctgtgcattactgtgtgagagggggcagtggctggtcctttgactcctggggccagggaaccctggtcaccgtctcctca

SEQ ID NO: 510 - protein, 118 aa, Artificial Sequence
  Synthetic
QVQLVQSGGGVVQPGRSLRLSCAASGFTFSNYGMHWVRQAPGKGLEWLAVISYDGSNKHYVDSVKGRFTISRDNSKNTLYLQMNSLRAEDTAVHYCVRGGSGWSFDSWGQGTLVTVSS

SEQ ID NO: 511 - DNA, 354 bp, Artificial Sequence
  Synthetic
gaggtgcagctgttggagtctgggggaggcgtggtccagcctgggaggtccctgagactctcctgtgcagcctctggattcaccttcagttaccatggcatgcactgggtccgccaggctccaggcaaggggctggagtggttggcagttatctcatatgatggcagcgatagacactatatagactccgtgaagggccgattcaccaatgccagagacaattccaagaacacgctgtatctgcaaatgaacagcctgagacctgaagacacggctgtgtattactgtgcgagagggggcagtggctggtcctttgactcctggggccagggaaccctggtcaccgtctcttca

SEQ ID NO: 512 - protein, 118 aa, Artificial Sequence
  Synthetic
EVQLLESGGGVVQPGRSLRLSCAASGFTFSYHGMHWVRQAPGKGLEWLAVISYDGSDRHYIDSVKGRFTNARDNSKNTLYLQMNSLRPEDTAVYYCARGGSGWSFDSWGQGTLVTVSS

SEQ ID NO: 513 - DNA, 354 bp, Artificial Sequence
  Synthetic
caggtgcagctggtgcagtctgggggaggcgtggtccagcctgggaggtccctgaaactctcctgtgcagcctctggattcaccttcaataattatggcatgcactgggtccgccaggctccaggcaaggggctggagtggttggcagttatatcatatgatggcaatgataaacactatgttgactccgtgaagggccgattcaccacttccaaagacaattccaagaacacgctgtatctgcaaatgaacagcctgagagttgaggacacggctgtgttttactgtgtgagagggggcagtggctggtcctttgactcctggggccagggaaccccggtcaccgtttcctca

SEQ ID NO: 514 - protein, 118 aa, Artificial Sequence
  Synthetic
QVQLVQSGGGVVQPGRSLKLSCAASGFTFNNYGMHWVRQAPGKGLEWLAVISYDGNDKHYVDSVKGRFTTSKDNSKNTLYLQMNSLRVEDTAVFYCVRGGSGWSFDSWGQGTPVTVSS

SEQ ID NO: 515 - DNA, 354 bp, Artificial Sequence
  Synthetic
caggtgcagctggtggagtctgggggaggcgtggtccagcctggggggtccctgagactctcctgtgcagcctctggattcaccttcagtagctatggcatgcactgggtccgccaggctccaggcaagggtctggaatgggtggcagttatatcatatgatggaagtaataaaaattatgcagactccgtgaagggccgatttaccatcttcagagacaattccaagaacacgctgtatctgttaatgaacaccttgagagctgaggacacggctgtatattattgtgcagaaaggggcagtggctggtcctttgactactggggccagggaaccctggtcaccgtctcctca

SEQ ID NO: 516 - protein, 118 aa, Artificial Sequence
  Synthetic
QVQLVESGGGVVQPGGSLRLSCAASGFTFSSYGMHWVRQAPGKGLEWVAVISYDGSNKNYADSVKGRFTIFRDNSKNTLYLLMNTLRAEDTAVYYCAERGSGWSFDYWGQGTLVTVSS

SEQ ID NO: 517 - DNA, 357 bp, Artificial Sequence
  Synthetic
caggtgcagctggtggagtctgggggaggcgtggtccagcctgggaggtccctgagactctcctgtgcagcctctggattcaccttcagtagctatggcatgcactgggtccgccaggctccaggcaaggggctggaatgggtggctgttatttcatatcaggaaagtaataaacactatgtagactccgtgaagggccgattcaccatctccagagacaattccaagaacacgctgtatctgcaaatgaacagcctgagagctgaggacacggctgtgtattactgtgcgcaaagtcgtggatacagctatggtctaggttactggggccagggaaccctggtcaccgtctcctca

SEQ ID NO: 518 - protein, 119 aa, Artificial Sequence; identical to SEQ ID NO: 58
  Synthetic

SEQ ID NO: 519 - DNA, 357 bp, Artificial Sequence
  Synthetic
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatttcatatcaggaaagtaataaacactatgtagactccgtgaagggccgattcaccatctccagagacaattccaagaacacgctgtttctgcaaatgaacagcctgagagctgaggacacggctgtgtattactgtgcgcaaagtcgtggatacagctttggtctaggttactggggccagggaacccggtccaccgtctcctca

SEQ ID NO: 520 - protein, 119 aa, Artificial Sequence
  Synthetic
QVQLVESGGGVVQPGRSLRLSCAASGFTFSSYGMHWVRQAPGKGLEWVAVISYQESNKHYVDSVKGRFTISRDNSKNTLFLQMNSLRAEDTAVYYCAQSRGYSFGLGYWGQGTRSTVSS

SEQ ID NO: 521 - DNA, 357 bp, Artificial Sequence
  Synthetic
gaggtgcagctggtgcagtctgggggaggcgtggtccagcctgggaggtccctgagactctcctgtgcagcctctggattcagcttcagtagctatggcatgcactgggtccgccaggctccaggcagggggctggagtgggtggcagttatatcatatgttggaattaataaatattatggagactccgtgaagggccgattcaccatctccagagacgattccaagaacacgctgtatctgcaaatgaacagcctgagagctgaggacacggctgtgtattactgtgcgaaaagtcgtggatacagttatggtctagtctactggggccagggaaccctggtcaccgtctcctca

SEQ ID NO: 522 - protein, 119 aa, Artificial Sequence
  Synthetic
EVQLVQSGGGVVQPGRSLRLSCAASGFSFSSYGMHWVRQAPGRGLEWVAVISYVGINKYYGDSVKGRFTISRDDSKNTLYLQMNSLRAEDTAVYYCAKSRGYSYGLVYWGQGTLVTVSS

SEQ ID NO: 523 - DNA, 357 bp, Artificial Sequence
  Synthetic
caggtgcagctggtgcagtctgggggaggcgtggtccagcctgggaggtccctgagactctcctgtgtagcctctggaatcatcttcagtagttatggcatgcactgggtccgccaggctccaggcaaggggctggagtgggtggcagttatagcatatgatggaagtaataaaaattatgtagactccgtgaagggccgattcaccatttccagagacaattccaagaacacgctgtatctgcaaatgaacagcctgagagctgaggacacggctgtgtattattgtgcgaaaagtcgtggatacagttatggtctagtctattggggccagggaaccatggtcaccgtctcctca

SEQ ID NO: 524 - protein, 119 aa, Artificial Sequence
  Synthetic
QVQLVQSGGGVVQPGRSLRLSCVASGIIFSSYGMHWVRQAPGKGLEWVAVIAYDGSNKNYVDSVKGRFTISRDNSKNTLYLQMNSLRAEDTAVYYCAKSRGYSYGLVYWGQGTMVTVSS

SEQ ID NO: 525 - DNA, 354 bp, Artificial Sequence
  Synthetic
caggtgcagctggtgcagtctgggggaggcgtggtccagcctgggaggtccctgagactctcctgtgcagcctctggattcaccttcagtagctatggcatgcactgggtccgccaggctccaggcaaggggctggagtgggtggcagttatttcatatcaggaaagtaataaacactatgtagactccgtgaagggccgattcaccatctccagagacaattccaagaacacgctgtatctgcaaatgaacagcctgagagctgaggacacggctgtgtattactgtgcgaaaagtcgtggatacagttatggtctaggttactggggccagggacccggtcacgtctcctca

SEQ ID NO: 526 - protein, 118 aa, Artificial Sequence
  Synthetic
QVQLVQSGGGVVQPGRSLRLSCAASGFTFSSYGMHWVRQAPGKGLEWVAVISYQESNKHYVDSVKGRFTISRDNSKNTLYLQMNSLRAEDTAVYYCAKSRGYSYGLGYWGQGPGHVSS

SEQ ID NO: 527 - DNA, 357 bp, Artificial Sequence
  Synthetic
gaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaacactatacagactccgtgaagggccgattcaccatctccagagacaattccaagaacacgctgtatctgcaaatgaacagcctgagagttgaggacacggctgtttattactgtgcgcaaagtcgtggatacagctatggtctaggctactggggccagggaaccctggtcaccgtctcctca

SEQ ID NO: 528 - protein, 119 aa, Artificial Sequence
  Synthetic
EVQLVESGGGVVQPGRSLRLSCAASGFTFSSYGMHWVRQAPGKGLEWVAVISYDGSNKHYTDSVKGRFTISRDNSKNTLYLQMNSLRVEDTAVYYCAQSRGYSYGLGYWGQGTLVTVSS

SEQ ID NO: 529 - DNA, 357 bp, Artificial Sequence
  Synthetic
caggtgcagctggtgcagtctgggggaggcgtggtccagcctgggaggtccctgagactctcctgtgcggcctctggattcaccttcagtagctatggcatgcactgggtccgccaggctccaggcaaggggctggagtgggtggcagttatttcatatcaggaaagtaataaacactatttagactccgtgaagggccgattcaccatctccagagacaattccaagaacacgctgtatctgcaaatgaacagcctgagagctgaggacacggctgtgtattactgtgcgaaaagtcgtggatacagctatggtctaggttactggggccagggaaccctggtcaccgtctcctca

SEQ ID NO: 530 - protein, 119 aa, Artificial Sequence
  Synthetic
QVQLVQSGGGVVQPGRSLRLSCAASGFTFSSYGMHWVRQAPGKGLEWVAVISYQESNKHYLDSVKGRFTISRDNSKNTLYLQMNSLRAEDTAVYYCAKSRGYSYGLGYWGQGTLVTVSS

SEQ ID NO: 531 - DNA, 366 bp, Artificial Sequence
  Synthetic
gaggtgcagctggtgcagtctgggggaggcttggtacagcctggggggtccctgagactctcctgtgcagcctctggattcacctttagcagctatgccatgagctgggtccgccaggctccagggaagggactggagtgggtctcagctattagtggtagtggtggtaacacatactacgcagactccgtgaagggccggttcaccatctccagagacaattccaagaacacgctgtatctgcaaatgaacagcctgagagccgaggacacggccgtatattactgtgcgaaagatccacatagcagtaattggcccgggttcttcgatctctggggccgtggcaccctggtcaccgtctcctca

SEQ ID NO: 532 - protein, 122 aa, Artificial Sequence
  Synthetic
EVQLVQSGGGLVQPGGSLRLSCAASGFTFSSYAMSWVRQAPGKGLEWVSAISGSGGNTYYADSVKGRFTISRDNSKNTLYLQMNSLRAEDTAVYYCAKDPHSSNWPGFFDLWGRGTLVTVSS

SEQ ID NO: 533 - DNA, 354 bp, Artificial Sequence
  Synthetic
caggtgcagctggtggagtctgggggaggcttggtacagcctggcaggtccctgagaatatcctgtgtagcctctggattcagctttgatgattatgccatgcactgggtccggcaagctccagggaagggcctggagtgggtctcaggtattagttggattagtggtagaataggctatgcggactctgtgaagggccgattcaccatctccagagacaacgccaagaaatccctgtatctgcaaatgaacagtctgagaactgaggacacggccttgtattactgtgtaaaagatgacaacagcagcttgggggactactggggccagggaaccctggtcactgtctcctca

SEQ ID NO: 534 - protein, 118 aa, Artificial Sequence
  Synthetic
QVQLVESGGGLVQPGRSLRISCVASGFSFDDYAMHWVRQAPGKGLEWVSGISWISGRIGYADSVKGRFTISRDNAKKSLYLQMNSLRTEDTALYYCVKDDNSSLGDYWGQGTLVTVSS

SEQ ID NO: 535 - DNA, 345 bp, Artificial Sequence
  Synthetic
caggtgcagctgcaggagtcgggcccaggactggtgaagccttcggagaccctgtccctcacctgcactgtctctggtggctccatcagtggttactactggagccggatccggcagcccccaggaaagggactggagtggattgggtatatctattacagtgggaacaccaactacgacccctccctcaagagtcgagtcaccatatctgtagacacgtccaagaaccagttctccctgaagctgaggtctgtgaccgccgcagacacggccgtatatcactgtgcgagactgggccgggcttttgatatctggggccaagggacaatggtcaccgtctcctca

SEQ ID NO: 536 - protein, 115 aa, Artificial Sequence
  Synthetic
QVQLQESGPGLVKPSETLSLTCTVSGGSISGYYWSRIRQPPGKGLEWIGYIYYSGNTNYDPSLKSRVTISVDTSKNQFSLKLRSVTAADTAVYHCARLGRAFDIWGQGTMVTVSS

SEQ ID NO: 537 - DNA, 342 bp, Artificial Sequence
  Synthetic
gaggtgcagctggtggagtctgggggaggcttggtacagcctggggggtccctgagactctcctgtgcagcctctggattcacctttagcagctatgccatgaactgggtccgccaggctccagggaaggggctggaatgggtctcaactattagtggtagtagtggtagcacatactacgcagactccgtaaagggccggttcaccatctccagagacaattccaagaacacgctgtatctgcaaatgaacagcctgacagccgaggacacggccgtatattactgtgcgaaagtcggaggagacgtctggggccaagggaccacggtcaccgtctcctca

SEQ ID NO: 538 - protein, 114 aa, Artificial Sequence
  Synthetic
EVQLVESGGGLVQPGGSLRLSCAASGFTFSSYAMNWVRQAPGKGLEWVSTISGSSGSTYYADSVKGRFTISRDNSKNTLYLQMNSLTAEDTAVYYCAKVGGDVWGQGTTVTVSS

SEQ ID NO: 539 - DNA, 354 bp, Artificial Sequence
  Synthetic
caggtgcagctggtggaatctgggggaaccttggtacagcctggcaggtccctgagactctcctgtgcagcctctggattcacctttgatgattatgccatgcactgggtccggcaagctccagggaagggcctggagtgggtctcaggtattagttggattggaggtagaattggctatgcggactctgtgaagggccgattcaccatctccagagacaacgccaagaactccctgtatctgcaaatgaacagtctgagagctgaggacacggccttgtattactgtgtaaaagatgacaacagcagtttgggggactactggggccagggaaccctggtcaccgtctcctca

SEQ ID NO: 540 - protein, 118 aa, Artificial Sequence
  Synthetic
QVQLVESGGTLVQPGRSLRLSCAASGFTFDDYAMHWVRQAPGKGLEWVSGISWIGGRIGYADSVKGRFTISRDNAKNSLYLQMNSLRAEDTALYYCVKDDNSSLGDYWGQGTLVTVSS

SEQ ID NO: 541 - DNA, 354 bp, Artificial Sequence
  Synthetic
caggtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaagagtggtaggataggctatgcggactctgtgaagggccgattcaccatctccagagacaacgccaagaactccctgtatctgcaaatgaacagtctgagacctgaggacacggccttatattactgtgcaaaagatgacggcagcagtttgggggactactggggccagggaaccctggtcactgtctcctca

SEQ ID NO: 542 - protein, 118 aa, Artificial Sequence
  Synthetic
QVQLVESGGGLVQPGRSLRLSCAASGFTFDDYAMHWVRQAPGKGLEWVSGISWKSGRIGYADSVKGRFTISRDNAKNSLYLQMNSLRPEDTALYYCAKDDGSSLGDYWGQGTLVTVSS

SEQ ID NO: 543 - DNA, 360 bp, Artificial Sequence
  Synthetic
caggtgcagctggtgcagtctgggggaggcgtggtccagcctgggaggtccctgagactctcctgtgcagcctcgggattcaccttcagtagctatggcatgcactgggtccgccaggctccaggcaaggggctggagtgggtggcaattatatcatatgatggaattaataaatactatgtagactccgtgaagggccgattcaccatctccagagacaattccaagaacacgctgtatctgcaaatgaacagcctgagagctgaggacacggctgtgtatttctgtgcgaaaggggactacggtgacttcgatgcttttgatatctggggccaagggacaatggtcaccgtctcttca

SEQ ID NO: 544 - protein, 120 aa, Artificial Sequence
  Synthetic
QVQLVQSGGGVVQPGRSLRLSCAASGFTFSSYGMHWVRQAPGKGLEWVAIISYDGINKYYVDSVKGRFTISRDNSKNTLYLQMNSLRAEDTAVYFCAKGDYGDFDAFDIWGQGTMVTVSS

SEQ ID NO: 545 - DNA, 369 bp, Artificial Sequence
  Synthetic
gaggtgcagctggtgcagtctgggggaggcttggtaaagcctggggggtcccttagactctcctgtgcagcctctggattcactttcagtgacgcctggatgacttgggtccgccaggctccaggtaaggggctggagtggattggccgtattaaaagcaaaactgatggtgggacaacagactacgctgcacccgtgaaaggcagattcaccatttcaagagatgattcaaaaaacacgctgtatctgcaaatgaacagcctgaaaaccgaggacacagccgcatattactgtttcacagacgatttttggagtggggattatacgcactgctggggccagggaaccctggtcaccgtctcctccagc

SEQ ID NO: 546 - protein, 123 aa, Artificial Sequence
  Synthetic
EVQLVQSGGGLVKPGGSLRLSCAASGFTFSDAWMTWVRQAPGKGLEWIGRIKSKTDGGTTDYAAPVKGRFTISRDDSKNTLYLQMNSLKTEDTAAYYCFTDDFWSGDYTHCWGQGTLVTVSSS

SEQ ID NO: 547 - DNA, 324 bp, Artificial Sequence
  Synthetic
gacatccagatgacccagtctccatcttccctgtctgcatctgtaggaaacagagtcaccatcacttgccgggcaagtcagggcattagaaatgatttaggctggtatcagcaaaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttacccgctcactttcggcggagggaccaaggtggaaatcaaacga

SEQ ID NO: 548 - protein, 108 aa, Artificial Sequence
  Synthetic
DIQMTQSPSSLSASVGNRVTITCRASQGIRNDLGWYQQKPGKAPKRLIYAASSLQSGVPSRFSGSGSGTEFTLTISSLQPEDFATYYCLQHNSYPLTFGGGTKVEIKR

SEQ ID NO: 549 - DNA, 324 bp, Artificial Sequence
  Synthetic
gacatccagatgacccagtctccatcctccctgtctgcatctgtaggaaacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcaccggcagtggatctgggacagaattcactctcacaatcagcagcctgcagcctgaagattttgcaacttattactgtctacagcataatagttacccgctcactttcggcggagggaccaaggtggagatcaaacga

SEQ ID NO: 550 - protein, 108 aa, Artificial Sequence
  Synthetic
DIQMTQSPSSLSASVGNRVTITCRASQGIRNDLGWYQQKPGKAPKRLIYAASSLQSGVPSRFTGSGSGTEFTLTISSLQPEDFATYYCLQHNSYPLTFGGGTKVEIKR

SEQ ID NO: 551 - DNA, 324 bp, Artificial Sequence
  Synthetic
aacatcaagatgatccagtctccatcctccctgtttgcatcggtaggagtcacagtcaccatcacttgcagggccagtcagggcattagaaacaatttagtctggtatcagcagaaaccagggaaagcccctaagctcctgatatatgatgcatccagtttgcgaatttgggtgccatcaaggttcagcggcagcggatggggggcagaattcattctccccatcaacagccggcagccagaagattatgcaagttattattgtcgacagcataataaatatccgttcactttcggccaagggaccaagatggagatcaaacga

SEQ ID NO: 552 - protein, 108 aa, Artificial Sequence
  Synthetic
NIKMIQSPSSLFASVGVTVTITCRASQGIRNNLVWYQQKPGKAPKLLIYDASSLRIWVPSRFSGSGWGAEFILPINSRQPEDYASYYCRQHNKYPFTFGQGTKMEIKR

SEQ ID NO: 553 - DNA, 324 bp, Artificial Sequence
  Synthetic
gacatccagatgacccagtctccttcctccctgtctgcatctgtaggaaacagagtcaccatcacttgccgggccagtcagggcattagaagctggttggcctggtatcaccagaaaccagggaaagcccctaagctcctgatctatgctgcgtccagtttacaaagtggggtcccatcaaggttcagcggcagtggatctgggacagaattcactctcaccatcagcagcctgcagcctgatgattttgcaacttattactgccaacagtataatagttattcgtacacttttggccaagggaccaaggtggagatcaaacga

SEQ ID NO: 554 - protein, 108 aa, Artificial Sequence
  Synthetic
DIQMTQSPSSLSASVGNRVTITCRASQGIRSWLAWYHQKPGKAPKLLIYAASSLQSGVPSRFSGSGSGTEFTLTISSLQPDDFATYYCQQYNSYSYTFGQGTKVEIKR

SEQ ID NO: 555 - DNA, 324 bp, Artificial Sequence
  Synthetic
gacatccagatgacccagtctccatcctccctgtctgcatctgtaggagacagagtcaccatcacttgccgggcaagtcagggcattagaaatgatttaggctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttattactgccaacaggataataattacccgtccacgttcggccaagggaccaaggtggagatcaaacga

SEQ ID NO: 556 - protein, 108 aa, Artificial Sequence
  Synthetic
DIQMTQSPSSLSASVGDRVTITCRASQGIRNDLGWYQQKPGKAPKLLIYAASSLQSGVPSRFSGSGSGTDFTLTISSLQPEDFATYYCQQDNNYPSTFGQGTKVEIKR

SEQ ID NO: 557 - DNA, 324 bp, Artificial Sequence
  Synthetic
gacatccagatgacccagtctccatcctccctgtctgcatctgtaggagacagagtcaccatcacttgtcgggcgagtcagggcattagcaattatttaggctggtatcagcagaaaccagggaaagcccctaagcccctgatctatgctgcatccagtttgcaaagtggggtcccatcaaggttcagcggcagtggatctgggacagatttcactctcaccatcaccagcctgcagcctgaagattttgcaacttattactgtctacagcataatagttacccgttcactttcggccgagggaccaaggtggagatcaaacga

SEQ ID NO: 558 - protein, 108 aa, Artificial Sequence
  Synthetic
DIQMTQSPSSLSASVGDRVTITCRASQGISNYLGWYQQKPGKAPKPLIYAASSLQSGVPSRFSGSGSGTDFTLTITSLQPEDFATYYCLQHNSYPFTFGRGTKVEIKR

SEQ ID NO: 559 - DNA, 324 bp, Artificial Sequence
  Synthetic
gacatccagttgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttacccgtgcacttttggccaagggaccaaggtggaaatcaaacga

SEQ ID NO: 560 - protein, 108 aa, Artificial Sequence
  Synthetic
DIQLTQSPSSLSASVGDRVTITCRASQGIRNDLGWYQQKPGKAPKRLIYAASSLQSGVPSRFSGSGSGTEFTLTISSLQPEDFATYYCLQHNSYPCTFGQGTKVEIKR

SEQ ID NO: 561 - DNA, 324 bp, Artificial Sequence
  Synthetic
gacatccagttgacccagtctccatcctccctgtctgcatctgtaggaaacagagtcaccatcacttgccgggcaagtcagggcattagaaatgatttagcctggtatcagcagaaaccagggaaagcccctaagctcctgatctatgctgcatccactttgcaaacaggggtcccatctcggttcagtggcagtggatctgggacagatttcactctcaccatcagcagcctgcagcctgaagatgttgcaacttattactgtcaaaagtataacagtgcccctctcactttcggcggagggaccaaggtggagatcaaacga

SEQ ID NO: 562 - protein, 108 aa, Artificial Sequence
  Synthetic
DIQLTQSPSSLSASVGNRVTITCRASQGIRNDLAWYQQKPGKAPKLLIYAASTLQTGVPSRFSGSGSGTDFTLTISSLQPEDVATYYCQKYNSAPLTFGGGTKVEIKR

SEQ ID NO: 563 - DNA, 324 bp, Artificial Sequence
  Synthetic
gacatccagatgacccagtctccatcctccctgtctgcatctgtaggaaacagagtcaccatcacttgccgggcaagtcagggcattagaaatgatttaggctggtatcaccagaaaccagggaaagcccctaagctcctgatctatgctgcatccagtttacaaagtggggtcccatcaaggttcagcggcagtggatctggcacagatttcactctcaccatcagcagcctgcagcctgaagattttgcaacttattactgtctacaagattacaattaccctcggacgttcggccaagggaccaaggtggagatcaaacga

SEQ ID NO: 564 - protein, 108 aa, Artificial Sequence
  Synthetic
DIQMTQSPSSLSASVGNRVTITCRASQGIRNDLGWYHQKPGKAPKLLIYAASSLQSGVPSRFSGSGSGTDFTLTISSLQPEDFATYYCLQDYNYPRTFGQGTKVEIKR

SEQ ID NO: 565 - DNA, 324 bp, Artificial Sequence
  Synthetic
gacatccagatgacccagtctccatcctccctgtctgcatctgtaggagacagagtcaccatcacttgccgggcaagtcagggcattagaaatgatttaggctggtatcaccagaaaccagggaaagcccctaagctcctgatctatgctgcatccagtttgcaaagtggggtcccatcaaggttcagcggcagtggatctgggacagaattcactctcaccatcagcagcctgcagcctgaagattttgcaacttattactgtctacagcataatagttacccgttgactttcggccgagggaccaaggtggagatcaaacga

SEQ ID NO: 566 - protein, 108 aa, Artificial Sequence
  Synthetic
DIQMTQSPSSLSASVGDRVTITCRASQGIRNDLGWYHQKPGKAPKLLIYAASSLQSGVPSRFSGSGSGTEFTLTISSLQPEDFATYYCLQHNSYPLTFGRGTKVEIKR

SEQ ID NO: 567 - DNA, 324 bp, Artificial Sequence
  Synthetic
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttacccgctcactttcggcggagggaccaaggtggagatcaaacga

SEQ ID NO: 568 - protein, 108 aa, Artificial Sequence
  Synthetic
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGGGTKVEIKR

SEQ ID NO: 569 - DNA, 324 bp, Artificial Sequence
  Synthetic
gacatccagatgacccagtctccatcctccttgtctgcatctgttggaaacagagtcaccatcacttgccgggctagtcagggcattagaaatgatttaggctggtatcacctgaatccacggaaagccactaagcgcctgatctatgcagcatccattttgcaaagtggggtcccatcctggttcatcggcaatggatctgggacagatttcactctcacaatcagcagcctgcagcctgaagattttgcaacttattactgtctacaggataatagttaccctctcactttcggccgagggaccaaggtggagatcaaacga

SEQ ID NO: 570 - protein, 108 aa, Artificial Sequence
  Synthetic
DIQMTQSPSSLSASVGNRVTITCRASQGIRNDLGWYHLNPRKATKRLIYAASILQSGVPSWFIGNGSGTDFTLTISSLQPEDFATYYCLQDNSYPLTFGRGTKVEIKR

SEQ ID NO: 571 - DNA, 324 bp, Artificial Sequence
  Synthetic
gacatccagatgacccagtctccatcctccctgtctgcatctgtaggaaacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttacccgtggacgttcggccaagggaccaaggtggaaatcaaacga

SEQ ID NO: 572 - protein, 108 aa, Artificial Sequence
  Synthetic
DIQMTQSPSSLSASVGNRVTITCRASQGIRNDLGWYQQKPGKAPKRLIYAASSLQSGVPSRFSGSGSGTEFTLTISSLQPEDFATYYCLQHNSYPWTFGQGTKVEIKR

SEQ ID NO: 573 - DNA, 324 bp, Artificial Sequence
  Synthetic
gacatccagatgacccagtctccatcctccctgtctgcatctgtaggaaacagagtcaccatcacttgccgggcaagtcagggcattagaaatgatttaggctggtatcaccagaaaccagggaaagcccctaagcacctgatctatgctgcatccagtttgcaaagtggggtcccatcaaggttcaccggcagtggatctgggacagaattcactctcacaatcaccagcctgcagcctgaagattttgcaacttattactgtctacagcataatagttacccgtgcactttcggccaagggaccaaagtggagatcaaacga

SEQ ID NO: 574 - protein, 108 aa, Artificial Sequence
  Synthetic
DIQMTQSPSSLSASVGNRVTITCRASQGIRNDLGWYHQKPGKAPKHLIYAASSLQSGVPSRFTGSGSGTEFTLTITSLQPEDFATYYCLQHNSYPCTFGQGTKVEIKR

SEQ ID NO: 575 - DNA, 324 bp, Artificial Sequence
  Synthetic
gacatcccgatgacccagtctccatcctccctgtctgcatctgtaggaaacagagtcaccatcacttgccgggcgagtcagggctttaacaattatttagcctggtatcaccagaaaccagggaaagttcctaacctcctgatctatgctgcatccactttgcaatcaggggtcccatctcggttcagtggcagtggatctgggacagatttcactctcaccatccacagcctgcagcctgaagatgttgcaacttattactgtccaaagtataacagtgccccattcactttcggcccagggaccaaagtggagatcaaacga

SEQ ID NO: 576 - protein, 108 aa, Artificial Sequence
  Synthetic
DIPMTQSPSSLSASVGNRVTITCRASQGFNNYLAWYHQKPGKVPNLLIYAASTLQSGVPSRFSGSGSGTDFTLTIHSLQPEDVATYYCPKYNSAPFTFGPGTKVEIKR

SEQ ID NO: 577 - DNA, 324 bp, Artificial Sequence
  Synthetic
gacatccagatgacccagtctccatcctccctgtctgcatctgtaggagacagagtcaccatcacttgccgggcgagtcagggcattagcaattatttagcctggtatcagcagaaaccagggaaagctcctaagctcctgatctatgctgcatccactttgcaaacaggggtcccatcacggttcaccggcagtggatctgggacagatttcactctccccatcaacagcctgcagccggaagatgttgcaacttattactgtcaaaagtataacagagccccgctcactttcggcggagggaccaaagtggagatcaaacga

SEQ ID NO: 578 - protein, 108 aa, Artificial Sequence
  Synthetic
DIQMTQSPSSLSASVGDRVTITCRASQGISNYLAWYQQKPGKAPKLLIYAASTLQTGVPSRFTGSGSGTDFTLPINSLQPEDVATYYCQKYNRAPLTFGGGTKVEIKR

SEQ ID NO: 579 - DNA, 324 bp, Artificial Sequence
  Synthetic
gacatccagttgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttcccgctcactttcggcggagggaccaaggtggagatcaaacga

SEQ ID NO: 580 - protein, 108 aa, Artificial Sequence
  Synthetic
DIQLTQSPSSVSASVGDRVTITCRASQGISSWLAWYQQKPGKAPKLLIYAASSLQSGVPSRFSGSGSGTDFTLTISSLQPEDFATYYCQQANSFPLTFGGGTKVEIKR

SEQ ID NO: 581 - DNA, 324 bp, Artificial Sequence
  Synthetic
gacatccagatgacccagtctccatcctccctgtctgcatctgtaggagacagagtcaccatcacttgccgggcaagtcagggcattagaaatgatttaggctggtatcagcagaaaccagggaaagcccctaagctcctgatctatgctgcatccagtttgcaaagtggggtcccatcaaggttcaccggcattggatctgggacagaattcactctcaccatcaccagcctgcagcctgaacattttgcaacttattactgtctacaggctaataattacccgttcacttttggccaagggaccaagatggagatcaaacga

SEQ ID NO: 582 - protein, 108 aa, Artificial Sequence
  Synthetic
DIQMTQSPSSLSASVGDRVTITCRASQGIRNDLGWYQQKPGKAPKLLIYAASSLQSGVPSRFTGIGSGTEFTLTITSLQPEHFATYYCLQANNYPFTFGQGTKMEIKR

SEQ ID NO: 583 - DNA, 324 bp, Artificial Sequence
  Synthetic
gacatccagatgacccagtctccatcctccctgtctgcatctgtaggagacagagtcaccatcacttgccgggcgagtcagggcattagcatttatttagcctggtgtcagcagaaaccagggaaagcccctaagtccctgatctatgctgcatccagtttgcaaagtggggtcccatcaaagttcagcggcagtggatctgggacagaattcactctcaccatcagcagcctgcagcctgaagattttgcaacttattactgccaacagcttaatagttacccgctcactttcggccgagggaccaagctggagatcaaacga

SEQ ID NO: 584 - protein, 108 aa, Artificial Sequence
  Synthetic
DIQMTQSPSSLSASVGDRVTITCRASQGISIYLAWCQQKPGKAPKSLIYAASSLQSGVPSKFSGSGSGTEFTLTISSLQPEDFATYYCQQLNSYPLTFGRGTKLEIKR

SEQ ID NO: 585 - DNA, 339 bp, Artificial Sequence
  Synthetic
gatattgtgatgacccagactccactctcctcacctgtcacccttggacagccggcctccatctcctgcaggtctagtcaaagcctcgtacgcagtgatggaaacacctacttgagttggcttcagcagaggccaggccagcctccaagactcctaatttataagatttctaaccgattctctggggtcccagacagattcagtggcagtggggcagggacagatttcacactaaaaatcagcagggtggatgctgaggatgtcggggtttattactgcatgcaagctacacaatttcctttcactttcggccctgggaccaaggtggagatcaaacga

SEQ ID NO: 586 - protein, 113 aa, Artificial Sequence
  Synthetic
DIVMTQTPLSSPVTLGQPASISCRSSQSLVRSDGNTYLSWLQQRPGQPPRLLIYKISNRFSGVPDRFSGSGAGTDFTLKISRVDAEDVGVYYCMQATQFPFTFGPGTKVEIKR

SEQ ID NO: 587 - DNA, 339 bp, Artificial Sequence
  Synthetic
gatattgtgatgacccagactccactctcctcacctgtcacccttggacagccggcctccatctcctgcaggtctagtcaaagcctcgagaaaagtgatggaaacacctacttgagttggcttcagcagcggccaggccagcctccaagactcctaatttataagatttctaaccgtttctctggggtcccagacagattcagtggcagtggggcagggacagatttcacactgagaatcagcagggtggaagctgaggatgtcggaatttattactgcgtgcaaactacacaatttcctttcactttcggccctgggaccaaggtggagatcaaacga

SEQ ID NO: 588 - protein, 113 aa, Artificial Sequence
  Synthetic
DIVMTQTPLSSPVTLGQPASISCRSSQSLEKSDGNTYLSWLQQRPGQPPRLLIYKISNRFSGVPDRFSGSGAGTDFTLRISRVEAEDVGIYYCVQTTQFPFTFGPGTKVEIKR

SEQ ID NO: 589 - DNA, 324 bp, Artificial Sequence
  Synthetic
gacatccagttgacccagtctccatccttcctgtctgcatctgtaggaaacagagtcaccatcacttgctgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagcttaatagttaccctcggacgttcggccaagggaccaaggtggaaatcaaacga

SEQ ID NO: 590 - protein, 108 aa, Artificial Sequence
  Synthetic
DIQLTQSPSFLSASVGNRVTITCWASQGISSYLAWYQQKPGKAPKLLIYAASTLQSGVPSRFSGSGSGTEFTLTISSLQPEDFATYYCQQLNSYPRTFGQGTKVEIKR

SEQ ID NO: 591 - DNA, 324 bp, Artificial Sequence
  Synthetic
gacatccagatgacccagtctccatcctccctgtctgcatctgtaggaaacagagtcaccatcacttgccgggcgagtcagggcattagcaattatttagcctgctatcatcagaaaccagggaaagttcctaagctcctgatctatgctgcatccactttgcaatcaggggtcccatctcggttcagtggcagtggatctgggacagatttcactctcaccatcagcagcctgcagcctgaagatgttgcaacttattactgccaaaagtataacagtgccccattcactttcggccctgggaccaaagtggatatcaaacga

SEQ ID NO: 592 - protein, 108 aa, Artificial Sequence
  Synthetic
DIQMTQSPSSLSASVGNRVTITCRASQGISNYLACYHQKPGKVPKLLIYAASTLQSGVPSRFSGSGSGTDFTLTISSLQPEDVATYYCQKYNSAPFTFGPGTKVDIKR

SEQ ID NO: 593 - DNA, 342 bp, Artificial Sequence
  Synthetic
gacatccagatgacccagtctccagactccctggctgtgtctctgggcgagagggccaccatcaactgcaagtccagccagagtgttttatacagctccaacaataagaactacttagcttggttccagcagaaaccaggacagcctccttacctgctcatttcctgggcatctacccgggaatccggggtccctgaccgattcagtggcagcgggtctgggacagatttcactctcaccatcagcagcctgcaggctggagatgtggcagtttattactgtcagcaatattatagtattccgtggacgttcggccaagggaccaagctggagatcaaacga

SEQ ID NO: 594 - protein, 114 aa, Artificial Sequence
  Synthetic
DIQMTQSPDSLAVSLGERATINCKSSQSVLYSSNNKNYLAWFQQKPGQPPYLLISWASTRESGVPDRFSGSGSGTDFTLTISSLQAGDVAVYYCQQYYSIPWTFGQGTKLEIKR

SEQ ID NO: 595 - DNA, 342 bp, Artificial Sequence
  Synthetic
gccatccggatgacccagtctccagactccctggctatgtctctgggcgagagggccaccatcagctgcaagtccagccagagtgttttatacagctccaacaataagaactacttagcttggtatcagcagaaaccaggacagcctcctaagttgctcatttcctgggcatctacccgggaatccggggtccctgaccgattcagtggcagcgggtctgggacagatttcactctcaccatcagcagcctgcaggctgaagatgtggcagtttattactgtctgcaatattatagtattccgtggacgttcggccaagggaccaaggtggagatcaaacga

SEQ ID NO: 596 - protein, 114 aa, Artificial Sequence
  Synthetic
AIRMTQSPDSLAMSLGERATISCKSSQSVLYSSNNKNYLAWYQQKPGQPPKLLISWASTRESGVPDRFSGSGSGTDFTLTISSLQAEDVAVYYCLQYYSIPWTFGQGTKVEIKR

SEQ ID NO: 597 - DNA, 342 bp, Artificial Sequence
  Synthetic
gacatccagatgacccagtctccagactccctggctgtgtctctgggcgagagggccaccatcaactgcaagtccagccagaatcttttatacagctcccacaataagaactacttaacttggtaccagcagaaaccagggcagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatactactccgtacacttttggccaggggaccaaggtggagatcaaacga

SEQ ID NO: 598 - protein, 114 aa, Artificial Sequence
  Synthetic
DIQMTQSPDSLAVSLGERATINCKSSQNLLYSSHNKNYLTWYQQKPGQPPKLLIYWASTRESGVPDRFSGSGSGTDFTLTISSLQAEDVAVYYCQQYYTTPYTFGQGTKVEIKR

SEQ ID NO: 599 - DNA, 342 bp, Artificial Sequence
  Synthetic
gacatccagatgacccagtctccagactccctggctgtgtctctgggcgagagggccaccatcaactgcaagtccagccagagtgttttatacagctccaacaataagaactacttaacttggtaccagcagaaaccaggacagcctcctaaactgctcatttactggacatctacccgggaatccggggtccctgaccgattcagtggcagcgggtctgggacagatttcactctcaccatcagcagcctgcaggctgaagatgtggcagtttattactgtcagcaatattataatactccgtacacttttggccaggggaccaagctggagatcaaacga

SEQ ID NO: 600 - protein, 114 aa, Artificial Sequence
  Synthetic
DIQMTQSPDSLAVSLGERATINCKSSQSVLYSSNNKNYLTWYQQKPGQPPKLLIYWTSTRESGVPDRFSGSGSGTDFTLTISSLQAEDVAVYYCQQYYNTPYTFGQGTKLEIKR

SEQ ID NO: 601 - DNA, 342 bp, Artificial Sequence
  Synthetic
gacatccagatgacccagtctccagactccctggctgtgtctctgggcgagagggccaccatcaactgccagtccagccaaagtgttttatacagctccaaaaataagaactacttagcttggtaccagcagaaaccaggacagcctcctaatctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtggacgttcggccaagggaccaaggtggaaatcaaacga

SEQ ID NO: 602 - protein, 114 aa, Artificial Sequence
  Synthetic
DIQMTQSPDSLAVSLGERATINCQSSQSVLYSSKNKNYLAWYQQKPGQPPNLLIYWASTRESGVPDRFSGSGSGTDFTLTISSLQAEDVAVYYCQQYYSTPWTFGQGTKVEIKR

SEQ ID NO: 603 - DNA, 342 bp, Artificial Sequence
  Synthetic
gacatccagatgacccagtctccagactccctggctgtgtctctgggcgagagggccaccatcgactgcaagtccagccagagtgttttatccagctccaacaatgagaactacttaacatggtaccagcagaaaccaggacagcctcctaagttgctcatttactgggcatctacccgggaatccggggtccctgaccgattcagtggcagcgggtctgggacagatttcactctcaccatcagcagcctgcaggctgaagatgtggcagtttattactgtcagcaatattatagtattccgtacacttttggccaggggaccaaggtggaaatcaaacga

SEQ ID NO: 604 - protein, 114 aa, Artificial Sequence
  Synthetic
DIQMTQSPDSLAVSLGERATIDCKSSQSVLSSSNNENYLTWYQQKPGQPPKLLIYWASTRESGVPDRFSGSGSGTDFTLTISSLQAEDVAVYYCQQYYSIPYTFGQGTKVEIKR

SEQ ID NO: 605 - DNA, 342 bp, Artificial Sequence
  Synthetic
gacatccagatgacccagtctccagactccctggctgtgtctctgggcgagagggccaccatcaactgcaagtccagccagagtattttatacagctccaaaaataagaactacttagcttggtaccagcagaaaccaggacagcctcctaacctgctcatttactgggcatctacccgggaatccggggtccctgaccgattcagtggcagcgggtctgggacagatttcactctcaccatcagcagcctgcaggctgaagatgtggcattttattactgtcaccaatattatagtactccgtggacgttcggccaagggaccaaggtggaaatcaaacga

SEQ ID NO: 606 - protein, 114 aa, Artificial Sequence
  Synthetic
DIQMTQSPDSLAVSLGERATINCKSSQSILYSSKNKNYLAWYQQKPGQPPNLLIYWASTRESGVPDRFSGSGSGTDFTLTISSLQAEDVAFYYCHQYYSTPWTFGQGTKVEIKR

SEQ ID NO: 607 - DNA, 324 bp, Artificial Sequence
  Synthetic
gacatccagatgacccagtctccatcctccctgtctgcatctgtaggagacagagtcaccatcacttgccgggcaagtcagggcattagcaattatttaggctggtatcagcagaaaccagggaaagctcctaagcgcctgatgtatgctgcatccagtttgcaaaccggggtcccatctaggttcagcggcagtggatctgggacagaattcactctcaccatcagcagcctgcagcctgaagattttgcaacttattactgtctacagcataacagtgacccgctcactttcggcgcagggaccaaggtggagatcaaacga

SEQ ID NO: 608 - protein, 108 aa, Artificial Sequence
  Synthetic
DIQMTQSPSSLSASVGDRVTITCRASQGISNYLGWYQQKPGKAPKRLMYAASSLQTGVPSRFSGSGSGTEFTLTISSLQPEDFATYYCLQHNSDPLTFGAGTKVEIKR

SEQ ID NO: 609 - DNA, 342 bp, Artificial Sequence
  Synthetic
gacatccagatgacccagtctccaaactccctggctgtgtctctgggcgagagggcctccatcaactgcaagtccagccagaacattttattcaggtcccacaataagaacttcttaacttggtaccaacagaaaccaggacagcctcctaagctgctcatttactgggcatctacccgggaatccggggtccctgaccgattcagtggcaacgggtctgggacagatttcactctcaccatcagcagcctgcaggctgaagatgtggcggtttattactgtcagcaatattctagtactccgtacacttttggccaggggaccaaggtggaaatcaaacga

SEQ ID NO: 610 - protein, 114 aa, Artificial Sequence
  Synthetic
DIQMTQSPNSLAVSLGERASINCKSSQNILFRSHNKNFLTWYQQKPGQPPKLLIYWASTRESGVPDRFSGNGSGTDFTLTISSLQAEDVAVYYCQQYSSTPYTFGQGTKVEIKR

SEQ ID NO: 611 - DNA, 342 bp, Artificial Sequence
  Synthetic
gacatccagatgacccagtctccagactccctggctgtgtctctgggcgagagggccaccatcaactgcaagtccagccagagtgttttatacagctccaaaaataagaattacttagcttggtaccagcagaaaccaggacagtctcctaagctggtcatttactgggcatcaacccgggagtccggggtccctgaccgattcagtggcagcgggtctgggacagatttcactctcaccatcagcagcctgcaggctgaagatgtggcagtttattactgtcaccaatattatagttctccgtggacgttcggccaagggaccaaggtggaaatcaaacga

SEQ ID NO: 612 - protein, 114 aa, Artificial Sequence
  Synthetic
DIQMTQSPDSLAVSLGERATINCKSSQSVLYSSKNKNYLAWYQQKPGQSPKLVIYWASTRESGVPDRFSGSGSGTDFTLTISSLQAEDVAVYYCHQYYSSPWTFGQGTKVEIKR

SEQ ID NO: 613 - DNA, 342 bp, Artificial Sequence
  Synthetic
gacatccagatgacccagtctccagactccctggctgtgtctctgggcgagagggccaccatcaactgcaagtccagccagagtgttttatacagctccaaaaataagaactacttagcttggtaccagcagaaaccaggacagcctcctaagctgctcatttactgggcatctacccgggaatccggggtccctgaccgattcagtggcagcgggtctgggacaaatttcactctcaccatcagcggcctgcaggctgaagatgtggcagtttatttctgtcagcaatattatagtactccgtggacgttcggccaagggaccaaggtggaaatcaaacga

SEQ ID NO: 614 - protein, 114 aa, Artificial Sequence
  Synthetic
DIQMTQSPDSLAVSLGERATINCKSSQSVLYSSKNKNYLAWYQQKPGQPPKLLIYWASTRESGVPDRFSGSGSGTNFTLTISGLQAEDVAVYFCQQYYSTPWTFGQGTKVEIKR

SEQ ID NO: 615 - DNA, 342 bp, Artificial Sequence
  Synthetic
gacatccagatgacccagtctccagactccctggctgtgtctctgggcgagagggccaccatcaactgcaagtccagccagagtgttttatccagctccaacaataagaactacttaacttggtaccagcagaaaccaggacagcctcctaaactgctcatttactggacatctacccgggaatccggggtccctgaccgattcagtggcagcgggtctgggacagatttcactctcaccatcagcagcctgcaggctgaagatgtggcagtttattactgtcagcaatattataatattccgtacacttttggccaggggaccaaggtggaaatcaaacga

SEQ ID NO: 616 - protein, 114 aa, Artificial Sequence
  Synthetic
DIQMTQSPDSLAVSLGERATINCKSSQSVLSSSNNKNYLTWYQQKPGQPPKLLIYWTSTRESGVPDRFSGSGSGTDFTLTISSLQAEDVAVYYCQQYYNIPYTFGQGTKVEIKR

SEQ ID NO: 617 - DNA, 324 bp, Artificial Sequence
  Synthetic
gacatccagatgacccagtctccatcttccgtgtctgcatctgtaggagacagagtcaccatcacttgtcgggcgagtcagggtattcgcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaatttactattgtcaacaggttaacagtttcccgctcactttcggcggagggaccaaggtggaaatcaaacga

SEQ ID NO: 618 - protein, 108 aa, Artificial Sequence
  Synthetic
DIQMTQSPSSVSASVGDRVTITCRASQGIRSWLAWYQQKPGKAPKLLIYAASSLQSGVPSRFSGSGSGTDFTLTISSLQPEDFAIYYCQQVNSFPLTFGGGTKVEIKR

SEQ ID NO: 619 - DNA, 342 bp, Artificial Sequence
  Synthetic
gacatccagatgacccagtctccagactccctggctgtgtctctgggcgagagggccaccatcaactgcaagtccagccagagtgttttatacagctccagcaataagaactacttaacttggtaccagcagaaaccaggacagcctcctaaactgctcatttactgggcatctacccgggaatccggggtccctgaccgattcagtggcagcgggtctgggacagatttcactctcaccatcagcagcctgcaggctgaagatgtggcagtttattactgtcagcaatattataatattccgtacacttttggccaggggaccaaggtggagatcaaacga

SEQ ID NO: 620 - protein, 114 aa, Artificial Sequence
  Synthetic
DIQMTQSPDSLAVSLGERATINCKSSQSVLYSSSNKNYLTWYQQKPGQPPKLLIYWASTRESGVPDRFSGSGSGTDFTLTISSLQAEDVAVYYCQQYYNIPYTFGQGTKVEIKR

SEQ ID NO: 621 - DNA, 342 bp, Artificial Sequence
  Synthetic
gacatccagatgacccagtctccagactccctggctgtgtctctgggcgagagggccaccatcaactgcaagtccagccagagtgttttatacagctccaacaataagaactacttaacttggtaccagcagaaaccaggacagcctcctaagctgctcatttactggacatctacccgggaatccggggtccctgaccgattcagtggcagcgggtctgggacagatttcactctcaccatcagcagcctgcaggctgaagatgtggcagtttattactgtcagcaatattttagtactccgtacacttttggccaggggaccaaggtggagatcaaacga

SEQ ID NO: 622 - protein, 114 aa, Artificial Sequence
  Synthetic
DIQMTQSPDSLAVSLGERATINCKSSQSVLYSSNNKNYLTWYQQKPGQPPKLLIYWTSTRESGVPDRFSGSGSGTDFTLTISSLQAEDVAVYYCQQYFSTPYTFGQGTKVEIKR

SEQ ID NO: 623 - DNA, 324 bp, Artificial Sequence
  Synthetic
gacatccagatgacccagtctccatcttccgtgtctgcatctgtaggagacagagtcaccatcacttgtcgggcgagtcagggtattcgcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgtagattttgcaacttactattgtcaacaggttaacagtttcccgctcactttcggcggagggaccaaggtggaaatcaaacga

SEQ ID NO: 624 - protein, 108 aa, Artificial Sequence
  Synthetic
DIQMTQSPSSVSASVGDRVTITCRASQGIRSWLAWYQQKPGKAPKLLIYAASSLQSGVPSRFSGSGSGTDFTLTISSLQPVDFATYYCQQVNSFPLTFGGGTKVEIKR

SEQ ID NO: 625 - DNA, 342 bp, Artificial Sequence
  Synthetic
gacatccagatgacccagtctccagactccctggctgtgtctctgggcgagagggccaccatcaactgcaagtccagccagaatcttttatacagctcccacaataagaactacttaacttggtaccagcagaaaccagggcagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtacacttttggccaggggaccaaggtggaaatcaaacga

SEQ ID NO: 626 - protein, 114 aa, Artificial Sequence
  Synthetic
DIQMTQSPDSLAVSLGERATINCKSSQNLLYSSHNKNYLTWYQQKPGQPPKLLIYWASTRESGVPDRFSGSGSGTDFTLTISSLQAEDVAVYYCQQYYSTPYTFGQGTKVEIKR

SEQ ID NO: 627 - DNA, 342 bp, Artificial Sequence
  Synthetic
gacatccagatgacccagtctccacactccctggctgtgtctctgggcgagagggccaccatcaactgcaagtccagccagagtgttttatacagctccaaaaataagaactacttagcttggtaccagcagaaaccaggacaggctcctaagctgctcatttactgggcatctacccgggaatccggggtccctgaccgattcagtggcagcggttctgggacagatttcactctcaccatcagcagcctgcaggctgaagatgtggcagtttattactgtcaccaatattatagtaatccgtggacgttcggccaagggaccaaggtggaaatcaaacga

SEQ ID NO: 628 - protein, 114 aa, Artificial Sequence
  Synthetic
DIQMTQSPHSLAVSLGERATINCKSSQSVLYSSKNKNYLAWYQQKPGQAPKLLIYWASTRESGVPDRFSGSGSGTDFTLTISSLQAEDVAVYYCHQYYSNPWTFGQGTKVEIKR

SEQ ID NO: 629 - DNA, 324 bp, Artificial Sequence
  Synthetic
gccatccggatgacccagtctccatcctcactgtctgcatctgtaggagacagagtcaccatcacttgtcgggcgagtcagggcattagcaattatttagcctggtttcagcagaaaccagggaaagcccctaagtccctgatctatgctgcatccagtttgcaaagtggggtcccatcaaagttcagcggcagtggatctgggacagatttcactctcaccatcagcagcctgcagcctgaagattttgcaacttattactgccaacagtataatagttacccattcactttcggccctgggaccaagctggagatcaaacga

SEQ ID NO: 630 - protein, 108 aa, Artificial Sequence
  Synthetic
AIRMTQSPSSLSASVGDRVTITCRASQGISNYLAWFQQKPGKAPKSLIYAASSLQSGVPSKFSGSGSGTDFTLTISSLQPEDFATYYCQQYNSYPFTFGPGTKLEIKR

SEQ ID NO: 631 - DNA, 342 bp, Artificial Sequence
  Synthetic
gacatccagatgacccagtctccagactccctggctgtgtctctgggcgagagggccaccatcaactgcaagtccagccagagtgttttatacagctccaacaatgagaactacttaacttggtaccagcagaaaccaggacagcctcctaaactgctcatttactggacatctacccgggaatccggggtccctgaccgattcagtggcagcgggtctgggacagatttcactctcaccatcagcagcctgcaggctgaagatgtggcagtttattactgtcagcaatattatagtattccgtacacttttggccaggggaccaaggtggagatcaaacga

SEQ ID NO: 632 - protein, 114 aa, Artificial Sequence
  Synthetic
DIQMTQSPDSLAVSLGERATINCKSSQSVLYSSNNENYLTWYQQKPGQPPKLLIYWTSTRESGVPDRFSGSGSGTDFTLTISSLQAEDVAVYYCQQYYSIPYTFGQGTKVEIKR

SEQ ID NO: 633 - DNA, 324 bp, Artificial Sequence
  Synthetic
gacatccagatgacccagtctccatcttccgtgtctgcatctgtaggagacagagtcaccatcacttgtcgggcgagtcagggtattagcagctggttagcctggtatcagcagaaaccagggaaagcccctaacctcctgatctataatgcatccagtttacaaagtggggtcccatcacggttcagcggcagtggttctgggacagatttcactctcaccatcagcagcctgcagcctgaagattttgcaacttactattgtcaacaggctaacagcttccctctcactttcggcggagggaccaaggtggaaatcaaacga

SEQ ID NO: 634 - protein, 108 aa, Artificial Sequence
  Synthetic
DIQMTQSPSSVSASVGDRVTITCRASQGISSWLAWYQQKPGKAPNLLIYNASSLQSGVPSRFSGSGSGTDFTLTISSLQPEDFATYYCQQANSFPLTFGGGTKVEIKR

SEQ ID NO: 635 - DNA, 324 bp, Artificial Sequence
  Synthetic
gccatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcagaatagttacccgctcactttcggcggagggaccaaggtggaaatcaaacga

SEQ ID NO: 636 - protein, 108 aa, Artificial Sequence
  Synthetic
AIQMTQSPSSLSASVGDRVTITCRASQGIRNDLGWYQQKPGKAPKRLIYAASSLQSGVPSRFSGSGSGTEFTLTISSLQPEDFATYYCLQQNSYPLTFGGGTKVEIKR

SEQ ID NO: 637 - DNA, 324 bp, Artificial Sequence
  Synthetic
gacatccagatgacccagtctccatcctccctgtctacatctgtcggagacagagtcaccatcacttgccgggcaagtcagaccattagcagctatttagattggtatcagcagaaaccagggaaagcccctaagctcctgatctatgctgcatccagtttgcaaagtggggtcccatcaaggttcagtggcagtggatctgggacagatttaactctcaccatcaccagtctgcaacctgaaaattttgcaacttactactgtcaacagacttacagagccccgtacacttttggccaggggaccaaggtggaaaccaaacga

SEQ ID NO: 638 - protein, 108 aa, Artificial Sequence
  Synthetic
DIQMTQSPSSLSTSVGDRVTITCRASQTISSYLDWYQQKPGKAPKLLIYAASSLQSGVPSRFSGSGSGTDLTLTITSLQPENFATYYCQQTYRAPYTFGQGTKVETKR

SEQ ID NO: 639 - DNA, 342 bp, Artificial Sequence
  Synthetic
gacatccagttgacccagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctatattcactttcggccctgggaccaaggtggaaatcaaacga

SEQ ID NO: 640 - protein, 114 aa, Artificial Sequence
  Synthetic
DIQLTQSPLSLPVTLGQPASISCRSSQSLVYSDGNTYLNWFQQRPGQSPRRLIYKVSNRDSGVPDRFSGSGSGTDFTLKISRVEAEDVGVYYCMQGTHWPIFTFGPGTKVEIKR

SEQ ID NO: 641 - DNA, 342 bp, Artificial Sequence
  Synthetic
gccatccagatgacccagtctccactctccctgtccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctatattcactttcggccctgggaccaaggtggagatcaaacga

SEQ ID NO: 642 - protein, 114 aa, Artificial Sequence
  Synthetic
AIQMTQSPLSLSVTLGQPASISCRSSQSLVYSDGNTYLNWFQQRPGQSPRRLIYKVSNRDSGVPDRFSGSGSGTDFTLKISRVEAEDVGVYYCMQGTHWPIFTFGPGTKVEIKR

SEQ ID NO: 643 - DNA, 342 bp, Artificial Sequence
  Synthetic
gacatccagatgacccagtctccagactccctggctgtgtctctgggcgagagggccaccatcaactgcaagtccagccagagtgttttatacagctccaacaatcagaattacttagcttggtaccagcagaaaccaggacagcctcctaatctgctcatttactgggcatctacccgggaatccggggtccctgaccgattcagtggcagcgggtctgggacagatttcactctcaccatcagtagcctgcaggctgaagatgtggcagtttattactgtcagcaatattataatactccgtacacttttggccaggggaccaaggtggagatcaaacga

SEQ ID NO: 644 - protein, 114 aa, Artificial Sequence
  Synthetic
DIQMTQSPDSLAVSLGERATINCKSSQSVLYSSNNQNYLAWYQQKPGQPPNLLIYWASTRESGVPDRFSGSGSGTDFTLTISSLQAEDVAVYYCQQYYNTPYTFGQGTKVEIKR

SEQ ID NO: 645 - DNA, 324 bp, Artificial Sequence
  Synthetic
gacatccagatgacccagtctccatcctccctgtctgcatctgtaggagacagaggcaccgtcacttgccgggcaagtcagaacattcgcacctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacggtaccccgtacacttttggccaggggaccaaggtggagatcaaacga

SEQ ID NO: 646 - protein, 108 aa, Artificial Sequence
  Synthetic
DIQMTQSPSSLSASVGDRGTVTCRASQNIRTYLNWYQQKPGKAPKLLIYAASSLQSGVPSRFSGSGSGTDFTLTISSLQPEDFATYYCQQSYGTPYTFGQGTKVEIKR

SEQ ID NO: 647 - DNA, 342 bp, Artificial Sequence
  Synthetic
gacatccagttgacccagtctccagactccctggctgtgtctctgggcgagagggccaccatcaactgcaagtccagccagagtgttttatacagctccaacaataagaactacttaacttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaattttatagttttccgtacacttttggccaggggaccaaggtggaaatcaaacga

SEQ ID NO: 648 - protein, 114 aa, Artificial Sequence
  Synthetic
DIQLTQSPDSLAVSLGERATINCKSSQSVLYSSNNKNYLTWYQQKPGQPPKLLIYWASTRESGVPDRFSGSGSGTDFTLTISSLQAEDVAVYYCQQFYSFPYTFGQGTKVEIKR

SEQ ID NO: 649 - DNA, 342 bp, Artificial Sequence
  Synthetic
gacatccagatgacccagtctccaaactccctggctgtgtctctgggcgagagggccaccatcaactgcaagtccagccagagtgttttttacagttcctacaataagaaccacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtaccgagctcactttcggcggagggaccaaggtggagatcaaacga

SEQ ID NO: 650 - protein, 114 aa, Artificial Sequence
  Synthetic
DIQMTQSPNSLAVSLGERATINCKSSQSVFYSSYNKNHLAWYQQKPGQPPKLLIYWASTRESGVPDRFSGSGSGTDFTLTISSLQAEDVAVYYCQQYYSTELTFGGGTKVEIKR

SEQ ID NO: 651 - DNA, 324 bp, Artificial Sequence; identical to SEQ ID NO: 327
  Synthetic

SEQ ID NO: 652 - protein, 108 aa, Artificial Sequence; identical to SEQ ID NO: 64
  Synthetic

SEQ ID NO: 653 - DNA, 324 bp, Artificial Sequence
  Synthetic
gacatccagatgacccagtctccatcctccctgtctgcatctgtaggagacagaggcaccatcacttgccgggcaagtcagatcattaacacctatttaaattggtatcagcagaagccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagttccccgttcacttttggccaggggaccaaggtggaaatcaaacga

SEQ ID NO: 654 - protein, 108 aa, Artificial Sequence
  Synthetic
DIQMTQSPSSLSASVGDRGTITCRASQIINTYLNWYQQKPGKAPKLLIYAASSLQSGVPSRFSGSGSGTDFTLTISSLQPEDFATYYCQQSYSSPFTFGQGTKVEIKR

SEQ ID NO: 655 - DNA, 342 bp, Artificial Sequence
  Synthetic
gacatcgtgatgacccagtctccagactccctggctgtgtctctgggcgagagggccaccatcaactgcaagtccagccagagtgttttatacagttccaacaataagaactatttagcttggtaccagcagaaaccaggacagcctcctaagttgctcttttactgggcatctgcccgggaatccggggtccctgaccgcttcagtggcagcgggtgtgggacagatttcactctcaccatcagcagcctgcaggctgaagatgtggcagtttattactgtcaccaatcgtataatattccgtacacttttggccaggggaccaaggtggaaatcaaacga

SEQ ID NO: 656 - protein, 114 aa, Artificial Sequence
  Synthetic
DIVMTQSPDSLAVSLGERATINCKSSQSVLYSSNNKNYLAWYQQKPGQPPKLLFYWASARESGVPDRFSGSGCGTDFTLTISSLQAEDVAVYYCHQSYNIPYTFGQGTKVEIKR

SEQ ID NO: 657 - DNA, 324 bp, Artificial Sequence
  Synthetic
gccatccagatgacccagtctccatccttcctgtctgcatctgtaggagacagagtcaccatcacttgctgggccagtcagggcattagcaattatttagcctggtatcagcaaaaaccagggaaagcccctaagttcctgatctatgctgcatccactttgcaaagtggggtcccatcaaggttcagcggcagtggatctgggacagaattcactctcacaatcagcagcctgcagcctgaagactttgcaacttattactgtctacagcttaataataacctattcattttcggccctgggaccaaggtggatatcaaacga

SEQ ID NO: 658 - protein, 108 aa, Artificial Sequence
  Synthetic
AIQMTQSPSFLSASVGDRVTITCWASQGISNYLAWYQQKPGKAPKFLIYAASTLQSGVPSRFSGSGSGTEFTLTISSLQPEDFATYYCLQLNNNLFIFGPGTKVDIKR

SEQ ID NO: 659 - DNA, 324 bp, Artificial Sequence
  Synthetic
gacatccagatgacccagtctccatcctcactgtctgcatctgtaggagacagagtcaccatcacttgtcgggcgagtcagggcattagcaattatttagcctggtttcagcagaaaccagggaaagcccctaagtacctgatctatgctgcatccagtttgcacagtggggtcccatcaaagttcagcggcagtggatctgggacagatttcactctcaccatcagcagcctgcagcctgaagattttgcaacttattactgccaacagtataatagttaccctctcactttcggcggagggaccaaggtggaaatcaaacga

SEQ ID NO: 660 - protein, 108 aa, Artificial Sequence
  Synthetic
DIQMTQSPSSLSASVGDRVTITCRASQGISNYLAWFQQKPGKAPKYLIYAASSLHSGVPSKFSGSGSGTDFTLTISSLQPEDFATYYCQQYNSYPLTFGGGTKVEIKR

SEQ ID NO: 661 - DNA, 324 bp, Artificial Sequence
  Synthetic
gacatccagatgacccagtctccatccttcctgtctgcatctgtaggagacagagtcaccatcacttgctgggccagtcagggcattagcagttatttagcctggtatcagcaaaaaccagggaaagcccctaagttcctgatctatgctgcatccactttgcaaagtggggtcccatcaaggttcagcggcagtggatctgggacagaattcactctcacaatcagcagcctgcagcctgaagactttgcaacttattactgtcaacagcttaataataacctattcattttcggccctgggaccaaggtggaaatcaaacga

SEQ ID NO: 662 - protein, 108 aa, Artificial Sequence
  Synthetic
DIQMTQSPSFLSASVGDRVTITCWASQGISSYLAWYQQKPGKAPKFLIYAASTLQSGVPSRFSGSGSGTEFTLTISSLQPEDFATYYCQQLNNNLFIFGPGTKVEIKR

SEQ ID NO: 663 - DNA, 342 bp, Artificial Sequence
  Synthetic
gacatccagatgacccagtctccagactccctggctgtgtctctgggcgagagggccaccatcaactgcaggtccaaccagagtgttttatacagctccaccaataagaactacttagcttggtaccagcagaaaccaggacagcctcctaagctgctcatttactgggcatctacccgggattccggggtccctgaccgattcagtggcagcgggtctgggacagatttcactctcaccatcagcagcctgcaggctgaagatgtggcaatttattactgtcagcaatattatagtatttatcggacgttcggccaagggaccaaggtggagatcaaacga

SEQ ID NO: 664 - protein, 114 aa, Artificial Sequence
  Synthetic
DIQMTQSPDSLAVSLGERATINCRSNQSVLYSSTNKNYLAWYQQKPGQPPKLLIYWASTRDSGVPDRFSGSGSGTDFTLTISSLQAEDVAIYYCQQYYSIYRTFGQGTKVEIKR

SEQ ID NO: 665 - DNA, 342 bp, Artificial Sequence
  Synthetic
gacatccagatgacccagtctccagactccctggctgtgtctctgggcgagagggccaccatcaactgcaggtccaaccagagtgttttatacagctccaccaataagaactacttagcttggtaccagcagaaaccaggacagcctcctaagctgctcatttactgggcatctacccgggattccggggtccctgaccgattcagtggcagcgggtctgggacagatttcactctcaccatcagcagcctgcaggctgaagatgtggcaatttattactgtcagcaatattatagtatttatcggacgttcggccaagggaccaaggtggaaatcaaacga

SEQ ID NO: 666 - protein, 114 aa, Artificial Sequence; identical to SEQ ID NO: 664
  Synthetic

SEQ ID NO: 667 - DNA, 342 bp, Artificial Sequence
  Synthetic
gacatcgtgatgacccagtctccatactccctggctgtgtctctgggcgagagggccaccatcaactgcaggtccagccaaaatcttttatacagctccaccaataagaactacttaccttggtaccagcagaaaccaggacagcctcctaagctgctcatttactgggcatctacccgggattccggggtccctgaccgattcagtggcagcgggtctgggacagatttcactctcaccatcagcagcctgcaggctgaagatgtggcagtttattactgtcagcaatattatagtatttatcggacgttcggccaagggaccaagctggagatcaaacga

SEQ ID NO: 668 - protein, 114 aa, Artificial Sequence
  Synthetic
DIVMTQSPYSLAVSLGERATINCRSSQNLLYSSTNKNYLPWYQQKPGQPPKLLIYWASTRDSGVPDRFSGSGSGTDFTLTISSLQAEDVAVYYCQQYYSIYRTFGQGTKLEIKR

SEQ ID NO: 669 - DNA, 5934 bp, Homo Sapiens
atggcaatgttgcctcccccaggacctcagagctttgtccatttcacaaaacagtctcttgccctcattgaacaacgcattgctgaaagaaaatcaaaggaacccaaagaagaaaagaaagatgatgatgaagaagccccaaagccaagcagtgacttggaagctggcaaacagctgcccttcatctatggggacattcctcccggcatggtgtcagagcccctggaggacttggacccctactatgcagacaaaaagactttcatagtattgaacaaagggaaaacaatcttccgtttcaatgccacacctgctttatatatgctttctcctttcagtcctctaagaagaatatctattaagattttagtacactccttattcagcatgctcatcatgtgcactattctgacaaactgcatatttatgaccatgaataacccaccggactggaccaaaaatgtcgagtacacttttactggaatatatacttttgaatcacttgtaaaaatccttgcaagaggcttctgtgtaggagaattcacttttcttcgtgacccgtggaactggctggattttgtcgtcattgtttttgcgtatttaacagaatttgtaaacctaggcaatgtttcagctcttcgaactttcagagtattgagagctttgaaaactatttctgtaatcccaggcctgaagacaattgtaggggctttgatccagtcagtgaagaagctttctgatgtcatgatcctgactgtgttctgtctgagtgtgtttgcactaattggactacagctgttcatgggaaacctgaagcataaatgttttcgaaattcacttgaaaataatgaaacattagaaagcataatgaataccctagagagtgaagaagactttagaaaatatttttattacttggaaggatccaaagatgctctcctttgtggtttcagcacagattcaggtcagtgtccagaggggtacacctgtgtgaaaattggcagaaaccctgattatggctacacgagctttgacactttcagctgggccttcttagccttgtttaggctaatgacccaagattactgggaaaacctttaccaacagacgctgcgtgctgctggcaaaacctacatgatcttctttgtcgtagtgattttcctgggctccttttatctaataaacttgatcctggctgtggttgccatggcatatgaagaacagaaccaggcaaacattgaagaagctaaacagaaagaattagaatttcaacagatgttagaccgtcttaaaaaagagcaagaagaagctgaggcaattgcagcggcagcggctgaatatacaagtattaggagaagcagaattatgggcctctcagagagttcttctgaaacatccaaactgagctctaaaagtgctaaagaaagaagaaacagaagaaagaaaaagaatcaaaagaagctctccagtggagaggaaaagggagatgctgagaaattgtcgaaatcagaatcagaggacagcatcagaagaaaaagtttccaccttggtgtcgaagggcataggcgagcacatgaaaagaggttgtctacccccaatcagtcaccactcagcattcgtggctccttgttttctgcaaggcgaagcagcagaacaagtctttttagtttcaaaggcagaggaagagatataggatctgagactgaatttgccgatgatgagcacagcatttttggagacaatgagagcagaaggggctcactgtttgtgccccacagaccccaggagcgacgcagcagtaacatcagccaagccagtaggtccccaccaatgctgccggtgaacgggaaaatgcacagtgctgtggactgcaacggtgtggtctccctggttgatggacgctcagccctcatgctccccaatggacagcttctgccagagggcacgaccaatcaaatacacaagaaaaggcgttgtagttcctatctcctttcagaggatatgctgaatgatcccaacctcagacagagagcaatgagtagagcaagcatattaacaaacactgtggaagaacttgaagagtccagacaaaaatgtccaccttggtggtacagatttgcacacaaattcttgatctggaattgctctccatattggataaaattcaaaaagtgtatctattttattgtaatggatccttttgtagatcttgcaattaccatttgcatagttttaaacacattatttatggctatggaacaccacccaatgactgaggaattcaaaaatgtacttgctataggaaatttggtctttactggaatctttgcagctgaaatggtattaaaactgattgccatggatccatatgagtatttccaagtaggctggaatatttttgacagccttattgtgactttaagtttagtggagctctttctagcagatgtggaaggattgtcagttctgcgatcattcagactgctccgagtcttcaagttggcaaaatcctggccaacattgaacatgctgattaagatcattggtaactcagtaggggctctaggtaacctcaccttagtgttggccatcatcgtcttcatttttgctgtggtcggcatgcagctctttggtaagagctacaaagaatgtgtctgcaagatcaatgatgactgtacgctcccacggtggcacatgaacgacttcttccactccttcctgattgtgttccgcgtgctgtgtggagagtggatagagaccatgtgggactgtatggaggtcgctggtcaagctatgtgccttattgtttacatgatggtcatggtcattggaaacctggtggtcctaaacctatttctggccttattattgagctcatttagttcagacaatcttacagcaattgaagaagaccctgatgcaaacaacctccagattgcagtgactagaattaaaaagggaataaattatgtgaaacaaaccttacgtgaatttattctaaaagcattttccaaaaagccaaagatttccagggagataagacaagcagaagatctgaatactaagaaggaaaactatatttctaaccatacacttgctgaaatgagcaaaggtcacaatttcctcaaggaaaaagataaaatcagtggttttggaagcagcgtggacaaacacttgatggaagacagtgatggtcaatcatttattcacaatcccagcctcacagtgacagtgccaattgcacctggggaatccgatttggaaaatatgaatgctgaggaacttagcagtgattcggatagtgaatacagcaaagtgagattaaaccggtcaagctcctcagagtgcagcacagttgataaccctttgcctggagaaggagaagaagcagaggctgaacctatgaattccgatgagccagaggcctgtttcacagatggttgtgtacggaggttctcatgctgccaagttaacatagagtcagggaaaggaaaaatctggtggaacatcaggaaaacctgctacaagattgttgaacacagttggtttgaaagcttcattgtcctcatgatcctgctcagcagtggtgccctggcttttgaagatatttatattgaaaggaaaaagaccattaagattatcctggagtatgcagacaagatcttcacttacatcttcattctggaaatgcttctaaaatggatagcatatggttataaaacatatttcaccaatgcctggtgttggctggatttcctaattgttgatgtttctttggttactttagtggcaaacactcttggctactcagatcttggccccattaaatcccttcggacactgagagctttaagacctctaagagccttatctagatttgaaggaatgagggtcgttgtgaatgcactcataggagcaattccttccatcatgaatgtgctacttgtgtgtcttatattctggctgatattcagcatcatgggagtaaatttgtttgctggcaagttctatgagtgtattaacaccacagatgggtcacggtttcctgcaagtcaagttccaaatcgttccgaatgttttgcccttatgaatgttagtcaaaatgtgcgatggaaaaacctgaaagtgaactttgataatgtcggacttggttacctatctctgcttcaagttgcaacttttaagggatggacgattattatgtatgcagcagtggattctgttaatgtagacaagcagcccaaatatgaatatagcctctacatgtatatttattttgtcgtctttatcatctttgggtcattcttcactttgaacttgttcattggtgtcatcatagataatttcaaccaacagaaaaagaagcttggaggtcaagacatctttatgacagaagaacagaagaaatactataatgcaatgaaaaagctggggtccaagaagccacaaaagccaattcctcgaccagggaacaaaatccaaggatgtatatttgacctagtgacaaatcaagcctttgatattagtatcatggttcttatctgtctcaacatggtaaccatgatggtagaaaaggagggtcaaagtcaacatatgactgaagttttatattggataaatgtggtttttataatccttttcactggagaatgtgtgctaaaactgatctccctcagacactactacttcactgtaggatggaatatttttgattttgtggttgtgattatctccattgtaggtatgtttctagctgatttgattgaaacgtattttgtgtcccctaccctgttccgagtgatccgtcttgccaggattggccgaatcctacgtctagtcaaaggagcaaaggggatccgcacgctgctctttgctttgatgatgtcccttcctgcgttgtttaacatcggcctcctgctcttcctggtcatgttcatctacgccatctttggaatgtccaactttgcctatgttaaaaaggaagatggaattaatgacatgttcaattttgagacctttggcaacagtatgatttgcctgttccaaattacaacctctgctggctgggatggattgctagcacctattcttaacagtaagccacccgactgtgacccaaaaaaagttcatcctggaagttcagttgaaggagactgtggtaacccatctgttggaatattctactttgttagttatatcatcatatccttcctggttgtggtgaacatgtacattgcagtcatactggagaattttagtgttgccactgaagaaagtactgaacctctgagtgaggatgactttgagatgttctatgaggtttgggagaagtttgatcccgatgcgacccagtttatagagttctctaaactctctgattttgcagctgccctggatcctcctcttctcatagcaaaacccaacaaagtccagctcattgccatggatctgcccatggttagtggtgaccggatccattgtcttgacatcttatttgcttttacaaagcgtgttttgggtgagagtggggagatggattctcttcgttcacagatggaagaaaggttcatgtctgcaaatccttccaaagtgtcctatgaacccatcacaaccacactaaaacggaaacaagaggatgtgtctgctactgtcattcagcgtgcttatagacgttaccgcttaaggcaaaatgtcaaaaatatatcaagtatatacataaaagatggagacagagatgatgatttactcaataaaaaagatatggcttttgataatgttaatgagaactcaagtccagaaaaaacagatgccacttcatccaccacctctccaccttcatatgatagtgtaacaaagccagacaaagagaaatatgaacaagacagaacagaaaaggaagacaaagggaaagacagcaaggaaagcaaaaaatag

SEQ ID NO: 670 - protein, 1977 aa, Homo Sapiens
MAMLPPPGPQSFVHFTKQSLALIEQRIAERKSKEPKEEKKDDDEEAPKPSSDLEAGKQLPFIYGDIPPGMVSEPLEDLDPYYADKKTFIVLNKGKTIFRFNATPALYMLSPFSPLRRISIKILVHSLFSMLIMCTILTNCIFMTMNNPPDWTKNVEYTFTGIYTFESLVKILARGFCVGEFTFLRDPWNWLDFVVIVFAYLTEFVNLGNVSALRTFRVLRALKTISVIPGLKTIVGALIQSVKKLSDVMILTVFCLSVFALIGLQLFMGNLKHKCFRNSLENNETLESIMNTLESEEDFRKYFYYLEGSKDALLCGFSTDSGQCPEGYTCVKIGRNPDYGYTSFDTFSWAFLALFRLMTQDYWENLYQQTLRAAGKTYMIFFVVVIFLGSFYLINLILAVVAMAYEEQNQANIEEAKQKELEFQQMLDRLKKEQEEAEAIAAAAAEYTSIRRSRIMGLSESSSETSKLSSKSAKERRNRRKKKNQKKLSSGEEKGDAEKLSKSESEDSIRRKSFHLGVEGHRRAHEKRLSTPNQSPLSIRGSLFSARRSSRTSLFSFKGRGRDIGSETEFADDEHSIFGDNESRRGSLFVPHRPQERRSSNISQASRSPPMLPVNGKMHSAVDCNGVVSLVDGRSALMLPNGQLLPEGTTNQIHKKRRCSSYLLSEDMLNDPNLRQRAMSRASILTNTVEELEESRQKCPPWWYRFAHKFLIWNCSPYWIKFKKCIYFIVMDPFVDLAITICIVLNTLFMAMEHHPMTEEFKNVLAIGNLVFTGIFAAEMVLKLIAMDPYEYFQVGWNIFDSLIVTLSLVELFLADVEGLSVLRSFRLLRVFKLAKSWPTLNMLIKIIGNSVGALGNLTLVLAIIVFIFAVVGMQLFGKSYKECVCKINDDCTLPRWHMNDFFHSFLIVFRVLCGEWIETMWDCMEVAGQAMCLIVYMMVMVIGNLVVLNLFLALLLSSFSSDNLTAIEEDPDANNLQIAVTRIKKGINYVKQTLREFILKAFSKKPKISREIRQAEDLNTKKENYISNHTLAEMSKGHNFLKEKDKISGFGSSVDKHLMEDSDGQSFIHNPSLTVTVPIAPGESDLENMNAEELSSDSDSEYSKVRLNRSSSSECSTVDNPLPGEGEEAEAEPMNSDEPEACFTDGCVRRFSCCQVNIESGKGKIWWNIRKTCYKIVEHSWFESFIVLMILLSSGALAFEDIYIERKKTIKIILEYADKIFTYIFILEMLLKWIAYGYKTYFTNAWCWLDFLIVDVSLVTLVANTLGYSDLGPIKSLRTLRALRPLRALSRFEGMRVVVNALIGAIPSIMNVLLVCLIFWLIFSIMGVNLFAGKFYECINTTDGSRFPASQVPNRSECFALMNVSQNVRWKNLKVNFDNVGLGYLSLLQVATFKGWTIIMYAAVDSVNVDKQPKYEYSLYMYIYFVVFIIFGSFFTLNLFIGVIIDNFNQQKKKLGGQDIFMTEEQKKYYNAMKKLGSKKPQKPIPRPGNKIQGCIFDLVTNQAFDISIMVLICLNMVTMMVEKEGQSQHMTEVLYWINVVFIILFTGECVLKLISLRHYYFTVGWNIFDFVVVIISIVGMFLADLIETYFVSPTLFRVIRLARIGRILRLVKGAKGIRTLLFALMMSLPALFNIGLLLFLVMFIYAIFGMSNFAYVKKEDGINDMFNFETFGNSMICLFQITTSAGWDGLLAPILNSKPPDCDPKKVHPGSSVEGDCGNPSVGIFYFVSYIIISFLVVVNMYIAVILENFSVATEESTEPLSEDDFEMFYEVWEKFDPDATQFIEFSKLSDFAAALDPPLLIAKPNKVQLIAMDLPMVSGDRIHCLDILFAFTKRVLGESGEMDSLRSQMEERFMSANPSKVSYEPITTTLKRKQEDVSATVIQRAYRRYRLRQNVKNISSIYIKDGDRDDDLLNKKDMAFDNVNENSSPEKTDATSSTTSPPSYDSVTKPDKEKYEQDRTEKEDKGKDSKESKK

SEQ ID NO: 671 - protein, 326 aa, Artificial Sequence
  Synthetic
MHRPRRRGTRPPPLALLAALLLAARGADAGNLKHKCFRNSLENNETLESIMNTLESEEDFRKYFYYLEGSKDALLCGFSTDSGQCPEGYTCVKIGRNPDDKTHTCPPCPAPELLGGPSVFPFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 672 - protein, 299 aa, Artificial Sequence
  Synthetic
MHRPRRRGTRPPPLALLAALLLAARGADAAGKFYECINTTDGSRFPASQVPNRSECFALMNVSQNVRWKNLKDKTHTCPPCPAPELLGGPSVFPFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 673 - protein, 369 aa, Artificial Sequence
  Synthetic
MHRPRRRGTRPPPLALLAALLLAARGADAGNLKHKCFRNSLENNETLESIMNTLESEEDFRKYFYYLEGSKDALLCGFSTDSGQCPEGYTCVKIGRNPDDKTHTCPPCPAPELLGGPSVFPFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKAGKFYECINTTDGSRFPASQVPNRSECFALMNVSQNVRWKNLK

SEQ ID NO: 674 - protein, 318 aa, Artificial Sequence
  Synthetic
MHRPRRRGTRPPPLALLAALLLAARGADATEFVNLGNVSALRTFRVLRALKTISVIPGLKDKTHTCPPCPAPELLGGPSVFPFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKTEFVNLGNVSALRTFRVLRALKTISVIPGLK

SEQ ID NO: 675 - protein, 27 aa, Artificial Sequence
  Synthetic
CSGGGGTEFVNLGNVSALRTCGGGGSC

SEQ ID NO: 676 - protein, 39 aa, Artificial Sequence
  Synthetic
KHKCFRNSLENNETLESIMNTLESEEDFRKYFYYLEGSK

SEQ ID NO: 677 - protein, 43 aa, Artificial Sequence
  Synthetic
AGKFYECINTTDGSRFPASQVPNRSECFALMNVSQNVRWKNLK

SEQ ID NO: 678 - protein, 70 aa, Artificial Sequence
  Synthetic
GNLKHKCFRNSLENNETLESIMNTLESEEDFRKYFYYLEGSKDALLCGFSTDSGQCPEGYTCVKIGRNPD

SEQ ID NO: 679 - protein, 31 aa, Artificial Sequence
  Synthetic
TEFVNLGNVSALRTFRVLRALKTISVIPGLK

SEQ ID NO: 680 - DNA, 357 bp, Artificial Sequence; identical to SEQ ID NO: 261
  Synthetic

SEQ ID NO: 681 - protein, 357 aa, Artificial Sequence
  Synthetic
CAGGTGCAGCTGGTGGAGTCGGGGGGAGGCGTGGTCCAGCCTGGGAGGTCCCTGAGACTCTCCTGTGCAGCCTCTGGATTCACCTTCAGTAGCTATGGCATGCACTGGGTCCGCCAGGCTCCAGGCAAGGGGCTGGAGTGGGTGGCTCTTATATCATATGTTGGAAGTAATAAACACTATGCAGACTCCGTGAAGGGCCGATTCACCATTTCCAGAGACAATTCCAAAAACACGCTGTATCTGCAAATGAACAGCCTGAGAGCTGAGGACACGGCTGTGTATTACTGTGCGAAAAGTCGTGGATACAGCTATGGTCTAGACTACTGGGGCCAGGGAACCCTGGTCACCGTCTCCTCA

SEQ ID NO: 682 - DNA, 342 bp, Artificial Sequence; identical to SEQ ID NO: 263
  Synthetic

SEQ ID NO: 683 - protein, 114 aa, Artificial Sequence; identical to SEQ ID NO: 264
  Synthetic

SEQ ID NO: 684 - DNA, 378 bp, Artificial Sequence
  Synthetic
gaggtgcagctggtggagtctgggggaggcttggtacagcctggggggtccctgagactctcctgtgcagcctctggattcacctttagcagctatggcatgagctgggtccgccaggttccagggaaggggctggagtgggtctcagctattagtggtagtggtggtagcacatactacgtagactccgtgaagggccggttcaccatctccagagacaatttcaagaacacgctgtatctgcaaatgaacagcctgagagtcgaggacacggccgtatattactgtgcgaaagatgtgggatattgtagtactaccagctgtaggggtgatgcatttgatgtctggggccaagggacaatggtcaccgtctcctca

SEQ ID NO: 685 - protein, 126 aa, Artificial Sequence
  Synthetic
EVQLVESGGGLVQPGGSLRLSCAASGFTFSSYGMSWVRQVPGKGLEWVSAISGSGGSTYYVDSVKGRFTISRDNFKNTLYLQMNSLRVEDTAVYYCAKDVGYCSTTSCRGDAFDVWGQGTMVTVSS

SEQ ID NO: 686 - DNA, 342 bp, Artificial Sequence; identical to SEQ ID NO: 619
  Synthetic

SEQ ID NO: 687 - protein, 114 aa, Artificial Sequence; identical to SEQ ID NO: 620
  Synthetic

SEQ ID NO: 688 - DNA, 366 bp, Artificial Sequence; identical to SEQ ID NO: 309
  Synthetic

SEQ ID NO: 689 - protein, 122 aa, Artificial Sequence; identical to SEQ ID NO: 310
  Synthetic

SEQ ID NO: 690 - DNA, 342 bp, Artificial Sequence; identical to SEQ ID NO: 311
  Synthetic

SEQ ID NO: 691 - protein, 114 aa, Artificial Sequence; identical to SEQ ID NO: 312
  Synthetic

SEQ ID NO: 692 - DNA, 366 bp, Artificial Sequence
  Synthetic
gaggtgcagctggtggagtctgggggaggcttggtacagcctggggggtccctgagactctcctgtgcagcctctggattcacctttagcaactatgccatgagctgggtccgccaggctccagggaaggggctggagtgggtctcagctattagtggtagtggtgataacacatactacgcagactccgtgaggggccggttcaccatctccagagacaattccaagaacacgctgtatctgcaaatgaacagtctgagagccgaggacacggccatatattactgtgcgaaagatccgcatagcagcaggtggcccgggttcttcgatctctggggccgtggcaccctggtcactgtctcctca

SEQ ID NO: 693 - protein, 122 aa, Artificial Sequence
  Synthetic
EVQLVESGGGLVQPGGSLRLSCAASGFTFSNYAMSWVRQAPGKGLEWVSAISGSGDNTYYADSVRGRFTISRDNSKNTLYLQMNSLRAEDTAIYYCAKDPHSSRWPGFFDLWGRGTLVTVSS

SEQ ID NO: 694 - DNA, 339 bp, Artificial Sequence
  Synthetic
gacatcgtgatgacccagtctccagactccctggctgtgtctctgggcgagagggccaccatcaactgcaagtccagccagagtgttttatacagctccaacaatcagaattacttagcttggtaccagcagaaaccaggacagcctcctaaactgctcatttactgggcatctacccgggaatccggggtccctgaccgattcagtggcagcgggtctgggacagatttcactctcaccatcagtagcctgcaggctgaagatgtggcagtttattactgtcagcaatattatagtactccgtacacttttggccaggggaccaagctggagatcaaa

SEQ ID NO: 695 - protein, 113 aa, Artificial Sequence
  Synthetic
DIVMTQSPDSLAVSLGERATINCKSSQSVLYSSNNQNYLAWYQQKPGQPPKLLIYWASTRESGVPDRFSGSGSGTDFTLTISSLQAEDVAVYYCQQYYSTPYTFGQGTKLEIK

SEQ ID NO: 696 - DNA, 364 bp, Artificial Sequence
  Synthetic
caggtgcagctgcagcagtggggcgcaggactgttgacgccttcggagaccctgtccctcacctgcgctgtctatggtgggtccttcagtggtcactactggagctggatccgccagcccccagggaaggggctggaatggattggggaaatcaatcctagaggaagcaccaactataaaccgtccctcaagagtcgagtcaccatatcagtagacacgtccaagaaccagttctccctgaacctgaggtctgtgaccgccgcggacacggctatgtattactgtgcgagagagggtaatttggcagctcgtctctggttcttcgatctctggggccgtggcaccctggtcaccgtctcctcaa

SEQ ID NO: 697 - protein, 121 aa, Artificial Sequence; identical to SEQ ID NO: 314
  Synthetic

SEQ ID NO: 698 - DNA, 324 bp, Artificial Sequence; identical to SEQ ID NO: 315
  Synthetic

SEQ ID NO: 699 - protein, 108 aa, Artificial Sequence; identical to SEQ ID NO: 316
  Synthetic

SEQ ID NO: 700 - DNA, 363 bp, Artificial Sequence
  Synthetic
caggtgcagctgcagcagtggggcgcaggactgttgaagccttcggagaccctgtccctcacctgcgctgtctatggtgggtccttcagtggtcactactggacctggatccggcagcccccagggaaggggctggagtggattggggaaatcaatcatagaggaaacaccaactataacccgtccctcaagagtcgagccaccatatcagtagacacgtccaagaaccagttctccctgaagctgagctctgtgaccgccgcggacacggctgtgtattactgtgcgagagagggtagtttggcagctcgtctctggtttttcgatctctggggccgtgacaccccggtcaccgtctcctca

SEQ ID NO: 701 - protein, 121 aa, Artificial Sequence
  Synthetic
QVQLQQWGAGLLKPSETLSLTCAVYGGSFSGHYWTWIRQPPGKGLEWIGEINHRGNTNYNPSLKSRATISVDTSKNQFSLKLSSVTAADTAVYYCAREGSLAARLWFFDLWGRDTPVTVSS

SEQ ID NO: 702 - DNA, 324 bp, Artificial Sequence; identical to SEQ ID NO: 645
  Synthetic

SEQ ID NO: 703 - protein, 108 aa, Artificial Sequence; identical to SEQ ID NO: 646
  Synthetic

SEQ ID NO: 704 - DNA, 360 bp, Artificial Sequence
  Synthetic
cagctgcagctgcaggagtcgggcccaggactggtgaagtcttcggagaccctgtccctcaaatgcactgtctctggtggctccatcagcagtagtggttactactggggctggatccgccagcccccagggaagggactggagtggattgggagtatccatcgtagtgggagcaccttctacaacccgtccctcaagagtcgagtcaccatatccgttgacacgtccaagagccagttctccctgaggctgacctctgtgaccgccgcagacacgtctgtgtatttctgtgggagacacggacgagactactactacggtatggacgtctggggccaagggaccacggtcaccgtctcc

SEQ ID NO: 705 - protein, 121 aa, Artificial Sequence
  Synthetic
QLQLQESGPGLVKSSETLSLKCTVSGGSISSSGYYWGWIRQPPGKGLEWIGSIHRSGSTFYNPSLKSRVTISVDTSKSQFSLRLTSVTAADTSVYFCGRHGRDYYYGMDVWGQGTTVTVSS

SEQ ID NO: 706 - DNA, 321 bp, Artificial Sequence
  Synthetic
gacatccagatgacccagtctccatcttccgtgtctgcatctgtaggagacagagtcaccatcacttgtcggtcgagtcaggatattaacaactggttagtctggtatcagcagaaaccagggaaagcccctaaggtcctgatatatggtgcttccagattgcaaagtggggtcccatcaaggttcagtggcagtggatctgggacagatttcactctcaccatcagcagtctgcagcctgaagattttgcaacttactattgtcaacaggctaacagtttcccgctcactttcggcggagggaccaaggtggagatcaaa

SEQ ID NO: 707 - protein, 107 aa, Artificial Sequence
  Synthetic
DIQMTQSPSSVSASVGDRVTITCRSSQDINNWLVWYQQKPGKAPKVLIYGASRLQSGVPSRFSGSGSGTDFTLTISSLQPEDFATYYCQQANSFPLTFGGGTKVEIK

SEQ ID NO: 708 - DNA, 342 bp, Artificial Sequence; identical to SEQ ID NO: 453
  Synthetic

SEQ ID NO: 709 - protein, 114 aa, Artificial Sequence; identical to SEQ ID NO: 454
  Synthetic

SEQ ID NO: 710 - DNA, 342 bp, Artificial Sequence
  Synthetic
gacatccagatgacccagtctccagactccctggctgtgtctctgggcgagagggccaccatcaactgcaagtccagccagagtgttttatacagctccaataataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtggacgttcggccaagggaccaaggtggaaatcaaacga

SEQ ID NO: 711 - protein, 114 aa, Artificial Sequence
  Synthetic
DIQMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPWTFGQGTKVEIKR

SEQ ID NO: 712 - protein, 44 aa, Artificial Sequence
  Synthetic
GGGGSKHKCFRNSLENNETLESIMNTLESEEDFRKYFYYLEGSK

SEQ ID NO: 713 - protein, 48 aa, Artificial Sequence
  Synthetic
GGGGSAGKFYECINTTDGSRFPASQVPNRSECFALMNVSQNVRWKNLK

SEQ ID NO: 714 - protein, 19 aa, Artificial Sequence
  Synthetic
GGGGSTEFVNLGNVSALRT

SEQ ID NO: 715 - protein, 39 aa, Rattus norvegicus
KHKCFRKELEENETLESIMNTAESEEELKKYFYYLEGSK

SEQ ID NO: 716 - protein, 43 aa, Rattus norvegicus
AGKFYECVNTTDGSRFPTSQVANRSECFALMNVSGNVRWKNLK

SEQ ID NO: 717 - protein, 19 aa, Artificial Sequence
  Synthetic
GGGGSTEFVDLGNVSALRT

SEQ ID NO: 718 - protein, 44 aa, Artificial Sequence
  Synthetic
GGGGSKHKCVQNSLVNNETLESIMNTLESEEDFRKYFYYLEGSK

SEQ ID NO: 719 - protein, 44 aa, Artificial Sequence
  Synthetic
GGGGSKHKCFRKDLEQNETLESIMSTAESEEELKRYFYYLEGSK

SEQ ID NO: 720 - protein, 43 aa, Mus musculus
AGKFYECVNTTDGSRFSVSQVANRSECFALMNVSGNVRWKNLK

SEQ ID NO: 721 - DNA, 351 bp, Artificial Sequence
  Synthetic
caggtgcagctggtggagtctgggggaggcgtggtccagcctgggaggtccctgagactctcctgtgcagcgtctggattcaccttcagtaactatggcatgcactgggtccgccaggctccaggcaaggggctggagtgggtggcagctatatggtttgatggaagtaataagaagtatgtagactccgtgaagggccgattcaccatctccagagacaattccaagaacacactgtatctgcaaatgaacagcctgagagccggggacacggctgtatattactgtacgagggatcggagtgggagctttgactattggggccagggaaccctggtcaccgtctcctca

SEQ ID NO: 722 - protein, 117 aa, Artificial Sequence
  Synthetic
QVQLVESGGGVVQPGRSLRLSCAASGFTFSNYGMHWVRQAPGKGLEWVAAIWFDGSNKKYVDSVKGRFTISRDNSKNTLYLQMNSLRAGDTAVYYCTRDRSGSFDYWGQGTLVTVSS

SEQ ID NO: 723 - DNA, 324 bp, Artificial Sequence; identical to SEQ ID NO: 559
  Synthetic

SEQ ID NO: 724 - protein, 108 aa, Artificial Sequence; identical to SEQ ID NO: 560
  Synthetic

SEQ ID NO: 725 - protein, 50 aa, Artificial Sequence
  Synthetic
AGKFYECINTTDGSRFPASQVPNRSECFALMNVSQNVRWKNLKVNFDNVG

SEQ ID NO: 726 - DNA, 354 bp, Artificial Sequence
  Synthetic
caggtgcaggtggtggagtctgggggaggcgtggtccagcctgggaggtccctgagactctcctgtgcagcctctggattcaccttcagtaactatggcatgcactgggtccgccaggctccaggcaaggggctggagtgggtaacagtaatatcatatgatggaagtaataaaaactatgcagactccgtgaagggccgattcaccatctccagagacaattccaagaacacgctgtatctgcaaatgaatagcctgagagctgaggacacggctatgtattactgtgcgagagggggcagtggctttgcttttgatatctggggccaagggacaatggtcaccgtctcttca

SEQ ID NO: 727 - protein, 118 aa, Artificial Sequence
  Synthetic
QVQVVESGGGVVQPGRSLRLSCAASGFTFSNYGMHWVRQAPGKGLEWVTVISYDGSNKNYADSVKGRFTISRDNSKNTLYLQMNSLRAEDTAMYYCARGGSGFAFDIWGQGTMVTVSS

SEQ ID NO: 728 - DNA, 24 bp, Artificial Sequence
  Synthetic
ggattcaccttcagtaactatggc

SEQ ID NO: 729 - protein, 8 aa, Artificial Sequence
  Synthetic
GFTFSNYG

SEQ ID NO: 730 - DNA, 24 bp, Artificial Sequence
  Synthetic
atatcatatgatggaagtaataaa

SEQ ID NO: 731 - protein, 8 aa, Artificial Sequence
  Synthetic
ISYDGSNK

SEQ ID NO: 732 - DNA, 33 bp, Artificial Sequence
  Synthetic
gcgagagggggcagtggctttgcttttgatatc

SEQ ID NO: 733 - protein, 11 aa, Artificial Sequence
  Synthetic
ARGGSGFAFDI

SEQ ID NO: 734 - DNA, 336 bp, Artificial Sequence
  Synthetic
gatattgtgatgacccagactccactctcctcacctgtcacccttggacagccggcctccatctcctgcaggtctagtcaaagcctcgtacgcagtgatggaaacacctacttgagttggcttcagcagaggccaggccagcctccaagactcctaatttataagatttctaaccggttctctggggtcccagacagattcagtggcagtggggcagggacagatttcacactgaaaatcagcagggtggaagctgacgatgtcggggtttattactgcatgcaaactacacaatttccattcactttcggccctgggaccaaagtggatatcaaa

SEQ ID NO: 735 - protein, 112 aa, Artificial Sequence
  Synthetic
DIVMTQTPLSSPVTLGQPASISCRSSQSLVRSDGNTYLSWLQQRPGQPPRLLIYKISNRFSGVPDRFSGSGAGTDFTLKISRVEADDVGVYYCMQTTQFPFTFGPGTKVDIK

SEQ ID NO: 736 - DNA, 33 bp, Artificial Sequence
  Synthetic
caaagcctcgtacgcagtgatggaaacacctac

SEQ ID NO: 737 - protein, 11 aa, Artificial Sequence
  Synthetic
QSLVRSDGNTY

SEQ ID NO: 738 - DNA, 9 bp, Artificial Sequence
  Synthetic
aagatttct

SEQ ID NO: 739 - protein, 3 aa, Artificial Sequence
  Synthetic
KIS

SEQ ID NO: 740 - DNA, 27 bp, Artificial Sequence
  Synthetic
atgcaaactacacaatttccattcact

SEQ ID NO: 741 - protein, 9 aa, Artificial Sequence
  Synthetic
MQTTQFPFT

SEQ ID NO: 742 - DNA, 354 bp, Artificial Sequence
  Synthetic
caggtgcaactggtggagtctgggggaggcgtggtccagcctgagaggtccctgagactctcctgtgcagcctctggattcaccttcagtagctatggcatgcactgggtccgccaggctccaggcgaggggctggagtgggtggcagtgatatcatatgatggaagtaatacaaagtatgcagactccgtgaggggccgattcaccatctccagagacaattccaagaacatgttgtatctgcaaatgaacagcctgagagctgaagacacggctgtgttttactgtgcgaggggatatagtggctacgcttttgactactggggccagggaatcctggtcaccgtctcctca

SEQ ID NO: 743 - protein, 118 aa, Artificial Sequence
  Synthetic
QVQLVESGGGVVQPERSLRLSCAASGFTFSSYGMHWVRQAPGEGLEWVAVISYDGSNTKYADSVRGRFTISRDNSKNMLYLQMNSLRAEDTAVFYCARGYSGYAFDYWGQGILVTVSS

SEQ ID NO: 744 - DNA, 24 bp, Artificial Sequence
  Synthetic
ggattcaccttcagtagctatggc

SEQ ID NO: 745 - protein, 8 aa, Artificial Sequence
  Synthetic
GFTFSSYG

SEQ ID NO: 746 - DNA, 24 bp, Artificial Sequence
  Synthetic
atatcatatgatggaagtaataca

SEQ ID NO: 747 - protein, 8 aa, Artificial Sequence
  Synthetic
ISYDGSNT

SEQ ID NO: 748 - DNA, 33 bp, Artificial Sequence
  Synthetic
gcgaggggatatagtggctacgcttttgactac

SEQ ID NO: 749 - protein, 11 aa, Artificial Sequence
  Synthetic
ARGYSGYAFDY

SEQ ID NO: 750 - DNA, 336 bp, Artificial Sequence
  Synthetic
gatattgtgatgacccagactccactctcctcacctgtcacccttggacagccggcctccatctcctgcaggtctagtcacagcctcgttcgcagtgatggaaacacctacttgagttggcttcagcagaggccaggccagcctccaagactcctaatttataagatttctaaccgattctctggggtcccagacagattcagtggcactggggcagggacagatttcacactgaaaatcaacagggtggaagctgaggatgtcgggttttattactgcatgcaagctacacaatttcctttcactttcggccctgggaccaaagtggatatcaaa

SEQ ID NO: 751 - protein, 112 aa, Artificial Sequence
  Synthetic
DIVMTQTPLSSPVTLGQPASISCRSSHSLVRSDGNTYLSWLQQRPGQPPRLLIYKISNRFSGVPDRFSGTGAGTDFTLKINRVEAEDVGFYYCMQATQFPFTFGPGTKVDIK

SEQ ID NO: 752 - DNA, 33 bp, Artificial Sequence
  Synthetic
cacagcctcgttcgcagtgatggaaacacctac

SEQ ID NO: 753 - protein, 11 aa, Artificial Sequence
  Synthetic
HSLVRSDGNTY

SEQ ID NO: 754 - DNA, 9 bp, Artificial Sequence
  Synthetic
aagatttct

SEQ ID NO: 755 - protein, 3 aa, Artificial Sequence
  Synthetic
KIS

SEQ ID NO: 756 - DNA, 27 bp, Artificial Sequence
  Synthetic
atgcaagctacacaatttcctttcact

SEQ ID NO: 757 - protein, 9 aa, Artificial Sequence
  Synthetic
MQATQFPFT

SEQ ID NO: 758 - DNA, 354 bp, Artificial Sequence
  Synthetic
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaaataataaatactatgcagactccgtgaagggccgattcaccatctccagagacaattccaagaacacgctgtatctgcaaatgaacagcctgagagctgaggacacggctgtgtattactgtgcgaaaggatctgctggctacgcccttgactactggggccagggaaccctggtcaccgtctcctca

SEQ ID NO: 759 - protein, 118 aa, Artificial Sequence
  Synthetic
QVQLVESGGGVVQPGRSLRLSCAASGFTFSSYGMHWVRQAPGKGLEWVAVISYDGNNKYYADSVKGRFTISRDNSKNTLYLQMNSLRAEDTAVYYCAKGSAGYALDYWGQGTLVTVSS

SEQ ID NO: 760 - DNA, 24 bp, Artificial Sequence
  Synthetic
ggattcaccttcagtagctatggc

SEQ ID NO: 761 - protein, 8 aa, Artificial Sequence
  Synthetic
GFTFSSYG

SEQ ID NO: 762 - DNA, 24 bp, Artificial Sequence
  Synthetic
atatcatatgatggaaataataaa

SEQ ID NO: 763 - protein, 8 aa, Artificial Sequence
  Synthetic
ISYDGNNK

SEQ ID NO: 764 - DNA, 33 bp, Artificial Sequence
  Synthetic
gcgaaaggatctgctggctacgcccttgactac

SEQ ID NO: 765 - protein, 11 aa, Artificial Sequence
  Synthetic
AKGSAGYALDY

SEQ ID NO: 766 - DNA, 336 bp, Artificial Sequence
  Synthetic
gatattgtgatgacccagactccactctcctcacctgtcacccttggacagccggcctccatctcctgcaggtctagtcaaagcctcgttcacagtgatggaaacacctacttgagttggcttcagcagaggccaggccagcctccaagactcctaatttataagatttctaaccggttctctggggtcccagacagattcattggcagtggggcagggacagatttcacactgagaatcagcagggtggaagctgaggatgtcggggtttattactgcatgcaagctacacaatttcctttcactttcggccctgggaccagagtggatatcaaa

SEQ ID NO: 767 - protein, 112 aa, Artificial Sequence
  Synthetic
DIVMTQTPLSSPVTLGQPASISCRSSQSLVHSDGNTYLSWLQQRPGQPPRLLIYKISNRFSGVPDRFIGSGAGTDFTLRISRVEAEDVGVYYCMQATQFPFTFGPGTRVDIK

SEQ ID NO: 768 - DNA, 33 bp, Artificial Sequence
  Synthetic
caaagcctcgttcacagtgatggaaacacctac

SEQ ID NO: 769 - protein, 11 aa, Artificial Sequence
  Synthetic
QSLVHSDGNTY

SEQ ID NO: 770 - DNA, 9 bp, Artificial Sequence
  Synthetic
aagatttct

SEQ ID NO: 771 - protein, 3 aa, Artificial Sequence
  Synthetic
KIS

SEQ ID NO: 772 - DNA, 27 bp, Artificial Sequence
  Synthetic
atgcaagctacacaatttcctttcact

SEQ ID NO: 773 - protein, 9 aa, Artificial Sequence
  Synthetic
MQATQFPFT

SEQ ID NO: 774 - DNA, 369 bp, Artificial Sequence; identical to SEQ ID NO: 17
  Synthetic

SEQ ID NO: 775 - protein, 123 aa, Artificial Sequence; identical to SEQ ID NO: 18
  Synthetic

SEQ ID NO: 776 - DNA, 24 bp, Artificial Sequence
  Synthetic
ggattcatgttcaatagatttggc

SEQ ID NO: 777 - protein, 8 aa, Artificial Sequence
  Synthetic
GFMFNRFG

SEQ ID NO: 778 - DNA, 24 bp, Artificial Sequence
  Synthetic
atatggtatgatggaagtaataaa

SEQ ID NO: 779 - protein, 8 aa, Artificial Sequence
  Synthetic
IWYDGSNK

SEQ ID NO: 780 - DNA, 48 bp, Artificial Sequence
  Synthetic
gcgagagagggcaccccccattactacgatagtagcggccttgactac

SEQ ID NO: 781 - protein, 16 aa, Artificial Sequence
  Synthetic
AREGTPHYYDSSGLDY

SEQ ID NO: 782 - DNA, 321 bp, Artificial Sequence; identical to SEQ ID NO: 19
  Synthetic

SEQ ID NO: 783 - protein, 107 aa, Artificial Sequence; identical to SEQ ID NO: 20
  Synthetic

SEQ ID NO: 784 - DNA, 18 bp, Artificial Sequence
  Synthetic
caggacattagaaatgat

SEQ ID NO: 785 - protein, 6 aa, Artificial Sequence
  Synthetic
QDIRND

SEQ ID NO: 786 - DNA, 9 bp, Artificial Sequence
  Synthetic
gatatatcc

SEQ ID NO: 787 - protein, 3 aa, Artificial Sequence
  Synthetic
DIS

SEQ ID NO: 788 - DNA, 27 bp, Artificial Sequence
  Synthetic
ctacaagattacaattacccgctcact

SEQ ID NO: 789 - protein, 9 aa, Artificial Sequence
  Synthetic
LQDYNYPLT

SEQ ID NO: 790 - DNA, 360 bp, Artificial Sequence
  Synthetic
gaggtgcagctggtggagtctgggggaggcctggtcaagcctggggggtccctgagactctcctgtgcagcctctggattcaccttcagtagctacaccattcactgggtccgccaggctccagggaaggggctggagtgggtctcatccattagtagtagtagtagttacatatactacgtagactcagtgaagggccgattcaccatctccagagacaacgccaagaactcagtgtatctgcaaatgaacagcctgagagccgaggacacggctgtctattactgtgcgacctcgagtataacagctcgaggttactttgactactggggccagggaaccctggtcaccgtctcctca

SEQ ID NO: 791 - protein, 120 aa, Artificial Sequence
  Synthetic
EVQLVESGGGLVKPGGSLRLSCAASGFTFSSYTIHWVRQAPGKGLEWVSSISSSSSYIYYVDSVKGRFTISRDNAKNSVYLQMNSLRAEDTAVYYCATSSITARGYFDYWGQGTLVTVSS

SEQ ID NO: 792 - DNA, 24 bp, Artificial Sequence
  Synthetic
ggattcaccttcagtagctacacc

SEQ ID NO: 793 - protein, 8 aa, Artificial Sequence
  Synthetic
GFTFSSYT

SEQ ID NO: 794 - DNA, 24 bp, Artificial Sequence
  Synthetic
attagtagtagtagtagttacata

SEQ ID NO: 795 - protein, 8 aa, Artificial Sequence
  Synthetic
ISSSSSYI

SEQ ID NO: 796 - DNA, 39 bp, Artificial Sequence
  Synthetic
gcgacctcgagtataacagctcgaggttactttgactac

SEQ ID NO: 797 - protein, 13 aa, Artificial Sequence
  Synthetic
ATSSITARGYFDY

SEQ ID NO: 798 - DNA, 321 bp, Artificial Sequence
  Synthetic
gaaattgtgttgacacagtctccagccaccctgtctttgtctccaggggaaagagtcaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtaacatctggcctccgacgttcggccaagggaccaaggtggaaatcaaa

SEQ ID NO: 799 - protein, 107 aa, Artificial Sequence
  Synthetic
EIVLTQSPATLSLSPGERVTLSCRASQSVSSYLAWYQQKPGQAPRLLIYDASNRATGIPARFSGSGSGTDFTLTISSLEPEDFAVYYCQQRNIWPPTFGQGTKVEIK

SEQ ID NO: 800 - DNA, 18 bp, Artificial Sequence
  Synthetic
cagagtgttagcagctac

SEQ ID NO: 801 - protein, 6 aa, Artificial Sequence
  Synthetic
QSVSSY

SEQ ID NO: 802 - DNA, 9 bp, Artificial Sequence
  Synthetic
gatgcatcc

SEQ ID NO: 803 - protein, 3 aa, Artificial Sequence
  Synthetic
DAS

SEQ ID NO: 804 - DNA, 27 bp, Artificial Sequence
  Synthetic
cagcagcgtaacatctggcctccgacg

SEQ ID NO: 805 - protein, 9 aa, Artificial Sequence
  Synthetic
QQRNIWPPT

SEQ ID NO: 806 - DNA, 354 bp, Artificial Sequence; identical to SEQ ID NO: 5
  Synthetic

SEQ ID NO: 807 - protein, 118 aa, Artificial Sequence; identical to SEQ ID NO: 6
  Synthetic

SEQ ID NO: 808 - DNA, 24 bp, Artificial Sequence
  Synthetic
ggattcaccttcagtagttatggc

SEQ ID NO: 809 - protein, 8 aa, Artificial Sequence
  Synthetic
GFTFSSYG

SEQ ID NO: 810 - DNA, 24 bp, Artificial Sequence
  Synthetic
atatcatatgatggaaataataaa

SEQ ID NO: 811 - protein, 8 aa, Artificial Sequence
  Synthetic
ISYDGNNK

SEQ ID NO: 812 - DNA, 33 bp, Artificial Sequence
  Synthetic
gcgagaggggccagtggctttgttcttgatatc

SEQ ID NO: 813 - protein, 11 aa, Artificial Sequence
  Synthetic
ARGASGFVLDI

SEQ ID NO: 814 - DNA, 336 bp, Artificial Sequence; identical to SEQ ID NO: 7
  Synthetic

SEQ ID NO: 815 - protein, 112 aa, Artificial Sequence; identical to SEQ ID NO: 8
  Synthetic

SEQ ID NO: 816 - DNA, 33 bp, Artificial Sequence
  Synthetic
caaagcctcgtacgcagtgatggaaatacctac

SEQ ID NO: 817 - protein, 11 aa, Artificial Sequence
  Synthetic
QSLVRSDGNTY

SEQ ID NO: 818 - DNA, 9 bp, Artificial Sequence
  Synthetic
aagatttct

SEQ ID NO: 819 - protein, 3 aa, Artificial Sequence
  Synthetic
KIS

SEQ ID NO: 820 - DNA, 27 bp, Artificial Sequence
  Synthetic
atgcaaactacacaatttccattcact

SEQ ID NO: 821 - protein, 9 aa, Artificial Sequence
  Synthetic
MQTTQFPFT

SEQ ID NO: 822 - DNA, 372 bp, Artificial Sequence; identical to SEQ ID NO: 25
  Synthetic

SEQ ID NO: 823 - protein, 124 aa, Artificial Sequence; identical to SEQ ID NO: 26
  Synthetic

SEQ ID NO: 824 - DNA, 24 bp, Artificial Sequence
  Synthetic
ggattcacctttagtatcttctgg

SEQ ID NO: 825 - protein, 8 aa, Artificial Sequence
  Synthetic
GFTFSIFW

SEQ ID NO: 826 - DNA, 24 bp, Artificial Sequence
  Synthetic
ataaagcaagatggaagtgagaaa

SEQ ID NO: 827 - protein, 8 aa, Artificial Sequence
  Synthetic
IKQDGSEK

SEQ ID NO: 828 - DNA, 51 bp, Artificial Sequence
  Synthetic
gcgagaggcgtttgggggagttatcgttatacctctagtggtttggacgtc

SEQ ID NO: 829 - protein, 17 aa, Artificial Sequence
  Synthetic
ARGVWGSYRYTSSGLDV

SEQ ID NO: 830 - DNA, 339 bp, Artificial Sequence; identical to SEQ ID NO: 27
  Synthetic

SEQ ID NO: 831 - protein, 113 aa, Artificial Sequence; identical to SEQ ID NO: 28
  Synthetic

SEQ ID NO: 832 - DNA, 33 bp, Artificial Sequence
  Synthetic
cagagcctcctgcacagtaatggatacaattat

SEQ ID NO: 833 - protein, 11 aa, Artificial Sequence
  Synthetic
QSLLHSNGYNY

SEQ ID NO: 834 - DNA, 9 bp, Artificial Sequence
  Synthetic
ttgggttct

SEQ ID NO: 835 - protein, 3 aa, Artificial Sequence
  Synthetic
LGS

SEQ ID NO: 836 - DNA, 30 bp, Artificial Sequence
  Synthetic
atgcaagctctacaagctctcccattcact

SEQ ID NO: 837 - protein, 10 aa, Artificial Sequence
  Synthetic
MQALQALPFT

SEQ ID NO: 838 - protein, 9 aa, Artificial Sequence
  Synthetic
CFRNSLENN

SEQ ID NO: 839 - protein, 16 aa, Artificial Sequence
  Synthetic
CINTTDGSRFPASQVP

SEQ ID NO: 840 - protein, 8 aa, Artificial Sequence
  Synthetic
CNVSQNVR

SEQ ID NO: 841 - protein, 8 aa, Artificial Sequence
  Synthetic
VNVDKQPC

SEQ ID NO: 842 - protein, 12 aa, Artificial Sequence
  Synthetic
EKEGQSQHMTEC

SEQ ID NO: 843 - protein, 9 aa, Artificial Sequence
  Synthetic
CKKEDGIND

SEQ ID NO: 844 - protein, 8 aa, Artificial Sequence
  Synthetic
CDPKKVHP

SEQ ID NO: 845 - protein, 8 aa, Artificial Sequence
  Synthetic
CFSTDSGQ

SEQ ID NO: 846 - protein, 19 aa, Artificial Sequence
  Synthetic
CTLESIMNTLESEEDFRKY

SEQ ID NO: 847 - protein, 9 aa, Artificial Sequence
  Synthetic
CPMTEEFKN

SEQ ID NO: 848 - protein, 11 aa, Artificial Sequence
  Synthetic
CTLPRWHMNDD

SEQ ID NO: 849 - protein, 10 aa, Artificial Sequence
  Synthetic
CIERKKTIKI

SEQ ID NO: 850 - protein, 12 aa, Artificial Sequence
  Synthetic
CEKEGQSQHMTE

SEQ ID NO: 851 - protein, 11 aa, Artificial Sequence
  Synthetic
DDCTLPRWHMN

SEQ ID NO: 852 - protein, 8 aa, Artificial Sequence
  Synthetic
CFSTDSGQ

SEQ ID NO: 853 - protein, 45 aa, Artificial Sequence
  Synthetic
KHKCFRNSLENNETLESIMNTLESEEDFRKYFYYLEGSKGGGGSK

SEQ ID NO: 854 - protein, 39 aa, Homo sapiens; identical to SEQ ID NO: 676

SEQ ID NO: 855 - protein, 49 aa, Artificial Sequence
  Synthetic
AGKFYECINTTDGSRFPASQVPNRSECFALMNVSQNVRWKNLKGGGGSK

SEQ ID NO: 856 - protein, 14 aa, Homo sapiens
TEFVNLGNVSALRT

SEQ ID NO: 857 - protein, 48 aa, Artificial Sequence
  Synthetic
AGKFYECVNTTDGSRFSVSQANRSECFALMNVSGNVRWKNLKGGGGSK

SEQ ID NO: 858 - protein, 49 aa, Artificial Sequence
  Synthetic
AGKFYECVNTTDGSRFPTSQVANRSECFALMNVSGNVRWKNLKGGGGSK

SEQ ID NO: 859 - DNA, 357 bp, Artificial Sequence
  Synthetic
gaggtgcagctggtggagtctgggggaggcttggtacagccgggggggtccctgagactctcctgtgcagcctctggattcaccttaagtagttatgccatgagctgggtccgccaggctccagggaaggggctggagtgggtctcaactattagtggtagtggtataatatactacacagactccgtgaagggccggttcaccatctccagagacagttccaagaacacgctgtatctgcaaatgaacagcctgagagtcgaggacacggccgtatattactgtgcgaaagatcgtggagcagcagctggagcctttgactactggggccagggaaccctggtcactgtctcctca

SEQ ID NO: 860 - protein, 119 aa, Artificial Sequence
  Synthetic
EVQLVESGGGLVQPGGSLRLSCAASGFTLSSYAMSWVRQAPGKGLEWVSTISGSGIIYYTDSVKGRFTISRDSSKNTLYLQMNSLRVEDTAVYYCAKDRGAAAGAFDYWGQGTLVTVSS

SEQ ID NO: 861 - DNA, 327 bp, Artificial Sequence
  Synthetic
gacatcgtgatgacccagtctccagactccctggctgtgtctctgggcgagagggccaccatcaaatgcaagtccagccagagtgttttatacagctccaacaataagaactacttagcttggtaccagcagaaaccaggacagcctcccaacctgctcatttactgggcatctacccgggaatccggggtccctgaccgattcagtggcagcgggtctgggacagatttcactctcaccatcagcagcctgcaggctgaagatgtggcagtttattactgtcagcaatatttctcgttcggccaagggaccaaggtggaaatcaaa

SEQ ID NO: 862 - protein, 109 aa, Artificial Sequence
  Synthetic
DIVMTQSPDSLAVSLGERATIKCKSSQSVLYSSNNKNYLAWYQQKPGQPPNLLIYWASTRESGVPDRFSGSGSGTDFTLTISSLQAEDVAVYYCQQYFSFGQGTKVEIK

SEQ ID NO: 863 - DNA, 363 bp, Artificial Sequence
  Synthetic
caggtacagctgcagcagtggggcgcaggactgttgaagccttcggagaccctgtccctcacctgcgctgtctatggtgggtccttcagtggtcactactggacctggatccggcagcccccagggaaggggctggagtggattggggaaatcaatcatagaggaaacaccaactataacccgtccctcaagagtcgagccaccatatcagtagacacgtccaagaaccagttctccctgaagctgagctctgtgaccgccgcggacacggctgtgtattactgtgcgagagagggtagtttggcagctcgtctctggtttttcgatctctggggccgtgacaccctggtcactgtctcctca

SEQ ID NO: 864 - protein, 121 aa, Artificial Sequence
  Synthetic
QVQLQQWGAGLLKPSETLSLTCAVYGGSFSGHYWTWIRQPPGKGLEWIGEINHRGNTNYNPSLKSRATISVDTSKNQFSLKLSSVTAADTAVYYCAREGSLAARLWFFDLWGRDTLVTVSS

SEQ ID NO: 865 - DNA, 321 bp, Artificial Sequence
  Synthetic
gacatccagatgacccagtctccatcctccctgtctgcatctgtaggagacagaggcaccgtcacttgccgggcaagtcagaacattcgcacctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacggtaccccgtacacttttggccaggggaccaagctggagatcaaa

SEQ ID NO: 866 - protein, 107 aa, Artificial Sequence
  Synthetic
DIQMTQSPSSLSASVGDRGTVTCRASQNIRTYLNWYQQKPGKAPKLLIYAASSLQSGVPSRFSGSGSGTDFTLTISSLQPEDFATYYCQQSYGTPYTFGQGTKLEIK

SEQ ID NO: 867 - DNA, 351 bp, Artificial Sequence
  Synthetic
caggtccagctggtacagtctggagctgaggtgaagaagcctggggcctcagtgaaggtctcctgcaaggcttctggttacacctttaccacctatggtatctcctgggtgcgacaggcccctggacaagggcttgagtggatgggatggatcagcgcttacaatggtaaaacaaactatgcacagaagttccagggcagagtcaccatgaccacagacacatccacgaacacagcctacatggagctgaggagcctgagatttgacgacacggccgtgtattactgtgcgagagacggtggaactcctttttactactggggccagggaaccctggtcaccgtctcctca

SEQ ID NO: 868 - protein, 117 aa, Artificial Sequence
  Synthetic
QVQLVQSGAEVKKPGASVKVSCKASGYTFTTYGISWVRQAPGQGLEWMGWISAYNGKTNYAQKFQGRVTMTTDTSTNTAYMELRSLRFDDTAVYYCARDGGTPFYYWGQGTLVTVSS

SEQ ID NO: 869 - DNA, 339 bp, Artificial Sequence
  Synthetic
gacatcgtgatgacccagtctccagactccctggctgtgtctctgggcgagagggccaccatcaactgcaagtccagccagagtgttttatacagctccaacaataagaactacttaggttggtaccagcagaaagcaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatggtattccgtggacgttcggccaagggaccaaggtggaaatcaaa

SEQ ID NO: 870 - protein, 113 aa, Artificial Sequence
  Synthetic
DIVMTQSPDSLAVSLGERATINCKSSQSVLYSSNNKNYLGWYQQKAGQPPKLLIYWASTRESGVPDRFSGSGSGTDFTLTISSLQAEDVAVYYCQQYYGIPWTFGQGTKVEIK

SEQ ID NO: 871 - DNA, 351 bp, Artificial Sequence
  Synthetic
caggtgcagctggtggagtctgggggaggcgtggtccagcctgggaggtccctgagactctcctgtgcagcgtctggattcaccttcagtaactatggcatgcactgggtccgccaggctccaggcaaggggctggagtgggtggcagctatatggtttgatggaagtaataagaagtatgtagactccgtgaagggccgattcaccatctccagagacaattccaagaacacactgtatctgcaaatgaacagcctgagagccggggacacggctgtatattactgtacgagggatcggagtgggagctttgactattggggccagggaaccctggtcactgtctcctca

SEQ ID NO: 872 - protein, 117 aa, Artificial Sequence; identical to SEQ ID NO: 722
  Synthetic

SEQ ID NO: 873 - DNA, 321 bp, Artificial Sequence
  Synthetic
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttacccttggacgttcggccaagggaccaaggtggagatcaaa

SEQ ID NO: 874 - protein, 107 aa, Artificial Sequence
  Synthetic
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPWTFGQGTKVEIK

What is claimed is:

1. An isolated human antibody or antigen-binding fragment thereof that specifically binds to extracellular loop 3 (EC3) within domain 1 (EC3-1) of human $Na_v1.7$, wherein EC3-1 of human $Na_v1.7$ comprises amino acid residues ranging from residue number 269 to residue 338 of SEQ ID NO: 670, and binds to EC3-1 of monkey $Na_v1.7$, wherein the antibody or antigen-binding fragment comprises six complementarity determining regions (HCDR1, HCDR2, HCDR3, LCDR1, LCDR2, LCDR3) contained within a heavy chain variable region/light chain variable region (HCVR/LCVR) amino acid sequence pair selected from the group consisting of SEQ ID NOs: 22/24, 30/32, 70/72, 102/104, and 759/767.

2. The human antibody or antigen-binding fragment of claim 1, comprising a HCVR/LCVR sequence pair selected from the group consisting of SEQ ID NOs: 22/24, 30/32, 70/72, 102/104, and 759/767.

3. The human antibody or antigen-binding fragment of claim 1, comprising six complementarity determining regions (HCDR1, HCDR2, HCDR3, LCDR1, LCDR2, LCDR3) contained within the HCVR/LCVR amino acid sequence pair of SEQ ID NOs: 70/72.

4. The human antibody or antigen-binding fragment of claim 3, comprising a HCVR having the amino acid sequence of SEQ ID NO: 70 and a LCVR having the amino acid sequence of SEQ ID NO: 72.

5. The human antibody or antigen binding fragment of claim 4, which is an antibody comprising a human IgG4 heavy chain constant region.

6. A pharmaceutical composition comprising an antibody or antigen-binding fragment of claim 1 and a pharmaceutically acceptable carrier.

7. A pharmaceutical composition comprising an antibody or antigen-binding fragment of claim 2 and a pharmaceutically acceptable carrier.

8. A pharmaceutical composition comprising an antibody or antigen-binding fragment of claim 3 and a pharmaceutically acceptable carrier.

9. A pharmaceutical composition comprising an antibody or antigen-binding fragment of claim 4 and a pharmaceutically acceptable carrier.

10. A pharmaceutical composition comprising an antibody or antigen-binding fragment of claim 5 and a pharmaceutically acceptable carrier.

* * * * *